United States Patent
White et al.

(10) Patent No.: US 9,714,289 B2
(45) Date of Patent: *Jul. 25, 2017

(54) ANTI-PVRIG ANTIBODIES AND METHODS OF USE

(71) Applicant: Compugen Ltd., Holon (IL)

(72) Inventors: Mark White, Antioch, CA (US); Sandeep Kumar, San Bruno, CA (US); Christopher Chan, South San Francisco, CA (US); Spencer Liang, San Mateo, CA (US); Lance Stapleton, Oakland, CA (US); Andrew W. Drake, Mountain View, CA (US); Yosi Gozlan, Tel Aviv (IL); Ilan Vaknin, Tel Aviv (IL); Shirley Sameah-Greenwald, Kfar Saba (IL); Liat Dassa, Tel Aviv (IL); Zohar Tiran, Oranit (IL); Gad S. Cojocaru, Tel Aviv (IL); Leonard Presta, San Francisco, CA (US); Richard Theolis, Santa Cruz, CA (US)

(73) Assignee: Compugen Ltd., Holon (IL)

(*) Notice: Subject to any disclaimer, the term of this patent is extended or adjusted under 35 U.S.C. 154(b) by 0 days.

This patent is subject to a terminal disclaimer.

(21) Appl. No.: 15/277,978

(22) Filed: Sep. 27, 2016

(65) Prior Publication Data

US 2017/0081408 A1 Mar. 23, 2017

Related U.S. Application Data

(63) Continuation of application No. 15/048,967, filed on Feb. 19, 2016.

(60) Provisional application No. 62/118,208, filed on Feb. 19, 2015, provisional application No. 62/141,120, filed on Mar. 31, 2015, provisional application No. 62/235,823, filed on Oct. 1, 2015.

(51) Int. Cl.
| | |
|---|---|
| *A61K 39/395* | (2006.01) |
| *C07K 16/28* | (2006.01) |
| *G01N 33/574* | (2006.01) |
| *C07K 7/06* | (2006.01) |
| *C12N 15/113* | (2010.01) |

(52) U.S. Cl.
CPC .......... *C07K 16/2803* (2013.01); *C07K 7/06* (2013.01); *G01N 33/57484* (2013.01); *C07K 2317/21* (2013.01); *C07K 2317/33* (2013.01); *C07K 2317/34* (2013.01); *C07K 2317/53* (2013.01); *C07K 2317/55* (2013.01); *C07K 2317/56* (2013.01); *C07K 2317/565* (2013.01); *C07K 2317/70* (2013.01); *C07K 2317/74* (2013.01); *C07K 2317/76* (2013.01); *C07K 2317/92* (2013.01); *C07K 2319/30* (2013.01); *C07K 2319/32* (2013.01); *C12N 15/1138* (2013.01); *C12N 2310/14* (2013.01); *G01N 2333/47* (2013.01)

(58) Field of Classification Search
None
See application file for complete search history.

(56) References Cited

U.S. PATENT DOCUMENTS

| | | | |
|---|---|---|---|
| 2007/0037206 | A1 | 2/2007 | Rosen et al. |
| 2011/0236903 | A1 | 9/2011 | McClelland et al. |
| 2014/0056890 | A1 | 2/2014 | Gurney et al. |

FOREIGN PATENT DOCUMENTS

| | | |
|---|---|---|
| EP | 2 067 791 | 6/2009 |
| WO | WO 00/52151 | 9/2000 |
| WO | WO 03/023013 | 3/2003 |
| WO | WO 2004/030615 | 4/2004 |
| WO | WO 2004/058805 | 7/2004 |
| WO | WO 2005/016962 | 2/2005 |
| WO | WO 2005/019258 | 3/2005 |
| WO | WO 2008/021290 | 2/2008 |
| WO | WO 2011/109637 | 9/2011 |
| WO | WO 2012/031008 | 3/2012 |
| WO | WO 2012/129488 | 9/2012 |
| WO | WO 2012/156515 | 11/2012 |
| WO | WO 2012/178128 | 12/2012 |
| WO | WO 2013/184912 | 12/2013 |

OTHER PUBLICATIONS

Stanietsky et al., The interaction of TIGIT with PVR and PVRL2 inhibits human NK cell cytotoxicity., Proc Natl Acad Sci U S A. Oct. 20, 2009;106(42):17858-63.
Yu et al., The surface protein TIGIT suppresses T cell activation by promoting the generation of mature immunoregulatory dendritic cells., Nat Immunol. Jan. 2009;10(1):48-57.
Zhu et al., Identification of CD112R as a novel checkpoint for human T cells., J Exp Med. Feb. 8, 2016;213(2):167-76.
Rotman et al., Identification of novel immune checkpoints as targets for cancer immunotherapy., J Immunother Cancer. 2013; 1(Suppl 1): P135.
Johnston et al., The immunoreceptor TIGIT regulates antitumor and antiviral CD8(+) T cell effector function., Cancer Cell. Dec. 8, 2014;26(6):923-37.
Orentas et al., Bioinformatic description of immunotherapy targets for pediatric T-cell leukemia and the impact of normal gene sets used for comparison., Front Oncol. Jun. 10, 2014;4:134.
Quinones et al., 2205 High-throughput cellular assays using a well-less plate format. Genentech, South San Francisco, CA, Curiox Biosystems, Singapore, New Technologies and Frontiers, Dec. 6, 2011.

*Primary Examiner* — Amy Juedes
(74) *Attorney, Agent, or Firm* — Christina A. MacDougall; Robin M. Silva; Morgan, Lewis & Bockius, LLP

(57) ABSTRACT

The present invention is directed to anti-PVRIG antibodies and methods of using same.

20 Claims, 213 Drawing Sheets

Figure 25

Human PVRIG WT Full length

Human PVRIG sequence starting from position 21 - alternative methionine

MGHRTLVLPWVLLTLCVTAGTPEVWVQVRMEATELSSFTIRCGFLGSGSISLVTVSWGGPNGAGGTTLAVLHPERGIR
QWAPARQARWETQSSISLILEGSGASSPCANTTFCCKFASFPEGSWEACGSLPPSSDPGLSAPPTPAPILRADLAGILGV
SGVLLFGCVYLLHLLRRHKHRPAPRLQPSRTSPQAPRARAWAPSQA (SEQ ID NO: 8)

Human PVRIG sequence starting from position 1 methionine

MRTEAQVPALQPPEPGLEGAMGHRTLVLPWVLLTLCVTAGTPEVWVQVRMEATELSSFTIRCGFLGSGSISLVTVSWG
GPNGAGGTTLAVLHPERGIRQWAPARQARWETQSSISLILEGSGASSPCANTTFCCKFASFPEGSWEACGSLPPSSDPG
LSAPPTPAPILRADLAGILGVSGVLLFGCVYLLHLLRRHKHRPAPRLQPSRTSPQAPRARAWAPSQA (SEQ ID NO: 9)

Alternative signal P with three C to S Mutations at the Fc domain
CGEN-PVRIGHH-2 Alternative SP (MGWSCIILFLVATATGVHS (SEQ ID NO: 10)) + CGEN-PVRIG (41-171 of PVRIG HUMAN) + Human IgG1 Fc mutated at C220S, C226S, C229S of hinge MGWSCIILFLVATATGVHSTPEVWVQVRMEATELSSFTIRCGFLGSGSISLVTVSWGGPNGAGGTTLAVLHPERGIRQW
APARQARWETQSSISLILEGSGASSPCANTTFCCKFASFPEGSWEACGSLPPSSDPGLSAPPTPAPILRADEPKSSDKTHT
SPPSPAPELLGGPSVFLFPPKPKDTLMISRTPEVTCVVVDVSHEDPEVKFNWYVDGVEVHNAKTKPREEQYNSTYRVVS
VLTVLHQDWLNGKEYKCKVSNKALPAPIEKTISKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEALHNHYTQKSLSLSPGK (SEQ ID NO: 11)

Figure 26

Human PVLR2 alpha isoform

>gi|5360210|ref|NP_002847.1| nectin-2 isoform alpha precursor [Homo sapiens]

MARAAALLPSRSPPTPLLWPLLLLLLLETGAQDVRVQVLPEVRGQLGGTVELPCHLLPPVPGLYISLVTW
QRPDAPANHQNVAAFHPKMGPSFPSPKPGSERLSFVSAKQSTGQDTEAELQDATLALHGLTVEDEGNYTC
EFATFPKGSVRGMTWLRVIAKPKNQAEAQKVTFSQDPTTVALCISKEGRPPARISWLSSLDWEAKETQVS
GTLAGTVTVTSRFTLVPSGRADGVTVTCKVEHESFEEPALIPVTLSVRYPPEVSISGYDDNWYLGRTDAT
LSCDVRSNPEPTGYDWSTTSGTFPTSAVAQGSQLVIHAVDSLFNTTFVCTVTNAVGMGRAEQVIFVRETP
RASPRDVGPLVWGAVGGTLLVLLLLAGGSLAFILLRVRRRRKSPGGAGGGASGDGGFYDPKAQVLGNGDP
VFWTPVVPGPMEPDGKDEEEEEEEEKAEKGLMLPPPPALEDDMESQLDGSLISRRAVYV (SEQ ID NO: 12)

Human PVLR2 delta isoform
>gi|112789532|ref|NP_001036189.1| nectin-2 isoform delta precursor [Homo sapiens]
MARAAALLPSRSPPTPLLWPLLLLLLLETGAQDVRVQVLPEVRGQLGGTVELPCHLLPPVPGLYISLVTW
QRPDAPANHQNVAAFHPKMGPSFPSPKPGSERLSFVSAKQSTGQDTEAELQDATLALHGLTVEDEGNYTC
EFATFPKGSVRGMTWLRVIAKPKNQAEAQKVTFSQDPTTVALCISKEGRPPARISWLSSLDWEAKETQVS
GTLAGTVTVTSRFTLVPSGRADGVTVTCKVEHESFEEPALIPVTLSVRYPPEVSISGYDDNWYLGRTDAT
LSCDVRSNPEPTGYDWSTTSGTFPTSAVAQGSQLVIHAVDSLFNTTFVCTVTNAVGMGRAEQVIFVRETP
NTAGAGATGGIIGGIIAAIIATAVAATGILICRQQRKEQTLQGAEEDEDLEGPPSYKPPTPKAKLEAQEM
PSQLFTLGASEHSPLKTPYFDAGASCTEQEMPRYHELPTLEERSGPLHPGATSLGSPIPVPPGPPAVEDV
SLDLEDEEGEEEEEYLDKINPIYDALSY (SEQ ID NO: 13)

Figure 31A

| Antibody (hIgG1) | EC$_{50}$ (HEK OE, nM) | HEK OE/par (5ug/ml, gMFlr) | Jurkat (5ug/ml, gMFlr) | CA46 (5ug/ml, gMFlr) |
|---|---|---|---|---|
| CPA.7.002 | 53.47 | 11.97 | 1.25 | 1.16 |
| CPA.7.003 | 7.12 | 1.28 | 3.85 | 6.71 |
| CPA.7.004 | 43.74 | 25.18 | 1.03 | 1.16 |
| CPA.7.005 | 125.50 | 15.77 | 0.93 | 1.02 |
| CPA.7.007 | 0.99 | 2.90 | 4.42 | 9.82 |
| CPA.7.008 | Not tested | Not tested | Not tested | Not tested |
| CPA.7.009 | 67.30 | 8.35 | 0.93 | 0.99 |
| CPA.7.010 | 30.00 | 18.76 | 1.08 | 1.01 |
| CPA.7.011 | 128.80 | 10.86 | 0.93 | 0.96 |
| CPA.7.012 | 0.40 | 2.01 | 4.89 | 8.23 |
| CPA.7.014 | 19.66 | 5.90 | 1.14 | 0.92 |
| CPA.7.015 | 1.74 | 6.64 | 4.3 | 7.33 |
| CPA.7.016 | 28.38 | 2.20 | 1.11 | 1.04 |
| CPA.7.017 | 2.62 | 4.56 | 0.99 | 1.49 |
| CPA.7.018 | 20.38 | 2.06 | 1.05 | 0.96 |
| CPA.7.019 | 2.11 | 1.94 | 4.66 | 9.23 |
| CPA.7.020 | 108.30 | 1.37 | 1.64 | 1.45 |
| CPA.7.021 | 12.41 | 30.59 | 4.47 | 7.96 |
| CPA.7.022 | 7.73 | 4.60 | 1.01 | 1.24 |
| CPA.7.023 | 10.90 | 20.31 | 0.9 | 1.01 |
| CPA.7.024 | 22.91 | 9.92 | 1.14 | 1.25 |
| CPA.7.025 | No binding | No binding | Not tested | Not tested |
| CPA.7.026 | 8.169 | 1.16 | 1.00 | 0.99 |
| CPA.7.027 | No binding | No binding | Not tested | Not tested |
| CPA.7.028 | 21.5 | 2.34 | 9.57 | 3.16 |
| CPA.7.029 | 3.87 | 1.24 | 1.17 | 0.85 |
| CPA.7.031 | No binding | No binding | Not tested | Not tested |
| CPA.7.032 | 49.62 | 4.50 | 1.81 | 1.64 |
| CPA.7.033 | 221 | 1.8221999 | 1.94 | 1.17 |
| CPA.7.034 | 55.69 | 4.12 | 1.25 | 1.01 |
| CPA.7.035 | No binding | No binding | Not tested | Not tested |
| CPA.7.036 | 14.19 | 5.68 | 1.69 | 1.46 |
| CPA.7.037 | Not reliable fit | 4.56 | 1.78 | 1.28 |

Figure 31B

| Antibody (hIgG1) | EC$_{50}$ (HEK OE, nM) | HEK OE/par (5ug/ml, gMFIr) | Jurkat (5ug/ml, gMFIr) | CA46 (5ug/ml, gMFIr) |
|---|---|---|---|---|
| CPA.7.038 | 2436 | 4.36 | Not tested | Not tested |
| CPA.7.039 | 2.99 | 6.52 | 1.55 | 1.40 |
| CPA.7.040 | 0.84 | 7.91 | 1.78 | 1.59 |
| CPA.7.041 | 14.35 | 3.25 | Not tested | Not tested |
| CPA.7.042 | 5.42 | 4.20 | 1.57 | 1.28 |
| CPA.7.043 | 7.63 | 5.47 | 1.20 | 1.08 |
| CPA.7.044 | 43.64 | 3.24 | 1.03 | 0.97 |
| CPA.7.045 | 5.17 | 4.04 | 1.68 | 1.05 |
| CPA.7.046 | Not reliable fit | Not tested | Not tested | Not tested |
| CPA.7.047 | 4.61 | 5.89 | 0.81 | 0.92 |
| CPA.7.049 | 1.94 | 2.56 | Not tested | Not tested |
| CPA.7.050 | 121.5 | 4.29 | 2.72 | 2.02 |

Figure 32A

| Antibody (hIgG1) | Human CD56 int. NK (gMFIr, 5ug/ml) | Human CD8+ T cells (gMFIr, 5ug/ml) | Expi cyno OE/par (gMFIr, 5ug/ml) | Cyno NK cells (gMFIr, 5ug/ml) | Cyno CD3+ T cells (gMFIr, 5ug/ml) |
|---|---|---|---|---|---|
| CPA.7.002 | 3.21 | 1.01 | 1.16 | 2.24 | 1.01 |
| CPA.7.003 | 16.21 | 1.41 | 1.36 | Not tested | Not tested |
| CPA.7.004 | 1.30 | 0.98 | 1.1 | Not tested | Not tested |
| CPA.7.005 | 2.35 | 1.07 | 1.21 | 1.12 | 0.99 |
| CPA.7.007 | 5.31 | 1.32 | 1.11 | Not tested | Not tested |
| CPA.7.008 | Not tested | Not tested | Not tested | Not tested | Not tested |
| CPA.7.009 | 1.34 | 0.98 | 1.08 | Not tested | Not tested |
| CPA.7.010 | 2.09 | 1.06 | 1.41 | Not tested | Not tested |
| CPA.7.011 | 1.19 | 1.02 | 1.06 | Not tested | Not tested |
| CPA.7.012 | 1.62 | 1.18 | 1.98 | Not tested | Not tested |
| CPA.7.014 | 1.57 | 0.98 | 1.06 | Not tested | Not tested |
| CPA.7.015 | 2.82 | 1.14 | 1.11 | Not tested | Not tested |
| CPA.7.016 | 2.39 | 1.05 | 1.43 | Not tested | Not tested |
| CPA.7.017 | 1.73 | 0.86 | 1.30 | Not tested | Not tested |
| CPA.7.018 | 1.62 | 1.04 | 1.06 | Not tested | Not tested |
| CPA.7.019 | 4.23 | 1.36 | 1.23 | Not tested | Not tested |
| CPA.7.020 | 3.12 | 1.07 | 3.10 | Not tested | Not tested |
| CPA.7.021 | 3.74 | 1.23 | 1.08 | 1.91 | 1.01 |
| CPA.7.022 | 1.27 | 0.87 | Not tested | Not tested | Not tested |
| CPA.7.023 | 1.11 | 0.99 | 1.08 | Not tested | Not tested |
| CPA.7.024 | 1.20 | 1.02 | 5.67 | 0.30 | 1.06 |
| CPA.7.025 | Not tested | Not tested | 1.41 | Not tested | Not tested |
| CPA.7.026 | 1.72 | 0.92 | 1.31 | Not tested | Not tested |
| CPA.7.027 | Not tested | Not tested | 1.45 | Not tested | Not tested |
| CPA.7.028 | 21.42 | 1.40 | 1.34 | Not tested | Not tested |
| CPA.7.029 | 1.24 | 0.90 | 1.29 | Not tested | Not tested |
| CPA.7.031 | Not tested | Not tested | 1.47 | Not tested | Not tested |
| CPA.7.032 | 10.43 | 0.93 | 1.46 | Not tested | Not tested |
| CPA.7.033 | 2.46 | 0.93 | 1.39 | Not tested | Not tested |
| CPA.7.034 | 1.05 | 0.89 | 1.33 | Not tested | Not tested |
| CPA.7.035 | Not tested | Not tested | 1.24 | Not tested | Not tested |
| CPA.7.036 | 4.17 | 0.87 | 1.24 | Not tested | Not tested |
| CPA.7.037 | 1.64 | 1.01 | 1.40 | Not tested | Not tested |
| CPA.7.038 | 18.08 | 1.03 | 7.88 | 3.35 | 1.01 |
| CPA.7.039 | 1.43 | 0.97 | 7.53 | 0.31 | 1.01 |

Figure 32B

| Antibody (hIgG1) | Human CD56 int. NK (gMFIr, 5ug/ml) | Human CD8+ T cells (gMFIr, 5ug/ml) | Expi cyno OE/par (gMFIr, 5ug/ml) | Cyno NK cells (gMFIr, 5ug/ml) | Cyno CD3+ T cells (gMFIr, 5ug/ml) |
|---|---|---|---|---|---|
| CPA.7.040 | 1.73 | 0.88 | 1.32 | Not tested | Not tested |
| CPA.7.041 | 6.15 | 1.01 | 3.31 | 1.26 | 0.98 |
| CPA.7.042 | 6.10 | 0.92 | 3.71 | 1.38 | 0.99 |
| CPA.7.043 | 1.10 | 0.83 | 1.50 | Not tested | Not tested |
| CPA.7.044 | 8.79 | 0.88 | 1.31 | Not tested | Not tested |
| CPA.7.045 | 1.28 | 0.84 | 1.43 | Not tested | Not tested |
| CPA.7.046 | Not tested | Not tested | 4.42 | Not tested | Not tested |
| CPA.7.047 | 0.99 | 0.90 | 1.29 | Not tested | Not tested |
| CPA.7.049 | Not tested | Not tested | 1.37 | Not tested | Not tested |
| CPA.7.050 | 4.98 | 1.23 | 1.47 | 0.64 | 1.03 | expi parental          cPVRIG transient expi parental          cPVRIG transient

Figure 37A

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.001 | GGTFSSYA | 14 | IIPIFGTA | 15 | AREEVSSPYGMDV | 16 | TGAVTSGHY | 17 | DTG | 18 | LLSYSGASWV | 19 |
| CPA.7.003 | GFSLSHFS | 20 | FDPEEGGT | 21 | ATGIWYSSGWPVDY | 22 | QSLLDSSGYNY | 23 | LGS | 24 | MQALQTPIT | 25 |
| CPA.7.004 | GYTLTELS | 26 | FDPEDGET | 27 | ATVSRVRGVINYYYYMDV | 28 | QSLLYRNGNNY | 29 | LGS | 30 | MQALQTPPT | 31 |
| CPA.7.006 | GGTFGTYA | 32 | ITPISATI | 33 | ARGFEYSDGLLDD | 34 | QSLFYSDDGNTY | 35 | RLS | 36 | MQHMEFPLT | 37 |
| CPA.7.008 | SGISISTNW | 38 | IYHSGST | 39 | ARVGPAAIYY | 40 | SNNVGYEG | 41 | RNN | 42 | SAWDSSLNAVV | 43 |
| CPA.7.009 | GYTLTELS | 44 | FDPEDGET | 45 | ATAKPGIAVAGQNYYYYMDV | 46 | QSLLYRNGNNY | 47 | LGS | 48 | MQALQTPPT | 49 |
| CPA.7.010 | GFTFSSYA | 50 | ISYDGSNK | 51 | ASSPIGYSYGYWGGMDV | 52 | SGIDVRTNK | 53 | EQSDSDK | 54 | LIWHTSGWV | 55 |
| CPA.7.011 | GYTLTELS | 56 | FDPEDGET | 57 | ATGPAAAGVGYYYYMDV | 58 | QSLLYRNGYNY | 59 | LGS | 60 | MQALQTPPT | 61 |
| CPA.7.012 | GFTFSSYA | 62 | ISYDGSNK | 63 | ARDVMVYCSSTSCYFYGMDV | 64 | QDIRDY | 65 | DAS | 66 | QQFENLPIT | 67 |
| CPA.7.013 | GYTLTELS | 68 | FDPEDGET | 69 | ATGGYSSGFNYYYYMDV | 70 | QSLLYRNGNNY | 71 | LGS | 72 | MQALQTPPT | 73 |
| CPA.7.014 | GYTLTELS | 74 | FDPEDGET | 75 | ATGVTTYYYYGMDV | 76 | QSLLYSNGNNF | 77 | LGS | 78 | MQALQTPPT | 79 |
| CPA.7.015 | GFTFSSYG | 80 | IRYDGSNK | 81 | ARDLFDFWWDGMDV | 82 | QSVSSMY | 83 | GAS | 84 | QQYVSSPMYT | 85 |
| CPA.7.017 | GGTFNNYG | 86 | IIPLFGTT | 87 | ARDRMAADGMAVFDY | 88 | SSNIGRHF | 89 | KND | 90 | SSWDAALNGVV | 91 |
| CPA.7.018 | GYTLTELS | 92 | FDPEDGET | 93 | ATEVPMVRGARRYYYYMDV | 94 | QTLLYINENNY | 95 | LGS | 96 | MQGLQTPPT | 97 |

Figure 37B

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.019 | GGSISNSNYY | 98 | IYYSGST | 99 | ARGAWELSLGDWFDP | 100 | SSNIGAGYD | 101 | GNN | 102 | QSYDSSLSVYVV | 103 |
| CPA.7.021 | GFTFGTSS | 104 | ISFDGTEI | 105 | AKGSGNIYFYSGMDV | 106 | QSISGW | 107 | ETS | 108 | QQYYSYPLT | 109 |
| CPA.7.022 | GYTLTELS | 110 | FDPEDGET | 111 | ATGVPAAIGVYYYYYMDV | 112 | QSLLYSNGYNY | 113 | LGS | 114 | MQALQSPVT | 115 |
| CPA.7.023 | GYTLTELS | 116 | FDPEDGET | 117 | ATDSRDGPAARGGYYYYMDV | 118 | QSLLYINGYNY | 119 | LGS | 120 | MQALQTPPT | 121 |
| CPA.7.024 | GGTFSSYA | 122 | IIPIFGTA | 123 | ARDAYYYDSSGYYNPDAFDI | 124 | QSLLHSNGYNY | 125 | LGS | 126 | MQGLQTPRT | 127 |
| CPA.7.033 | GGTFSSSA | 128 | IIPIYGIT | 129 | ARDDTARRVRGVPYYYYYAMDV | 130 | QDIDDD | 131 | EAS | 132 | LQHDNLPLT | 133 |
| CPA.7.034 | GYTLTELS | 134 | FDPEDGET | 135 | ATEDPGPVAGPYYYYGMDV | 136 | QSLLYINGYHY | 137 | LGS | 138 | MQALQTPPT | 139 |
| CPA.7.036 | GGTFSSSA | 140 | IIPIYGIT | 141 | ARDDTARRVRGVPYYYYYAMDV | 142 | QSLLDSDDGNTY | 143 | TLS | 144 | MQRLQFPLT | 145 |
| CPA.7.040 | GYTLTELS | 146 | FDPEDGET | 147 | ATGVPAAIGVYYYYYMDV | 148 | QSLLYRNGYNY | 149 | WGS | 150 | MQAVQNPPT | 151 |
| CPA.7.046 | GGTFSSSA | 152 | IIPIYGIT | 153 | ARDDTARRVRGVPYYYYYAMDV | 154 | QTMNNY | 155 | DAS | 156 | QQYGDWLPIT | 157 |
| CPA.7.047 | GYTLTELS | 158 | FDPEDGET | 159 | ATAFPEATSYYYYMDV | 160 | QSLLYRNGYNY | 161 | WGS | 162 | MQAVQNPPT | 163 |
| CPA.7.049 | GGTFSSSA | 164 | IIPIYGIT | 165 | ARDDTARRVRGVPYYYYYAMDV | 166 | RSLLDSDDGNTH | 167 | SLS | 168 | MQRKEFPLT | 169 |
| CPA.7.050 | GGTFSSYA | 170 | IIPIFGTA | 171 | ARGPWYYDSSGYSSYAYYMDV | 172 | QSLLHSDGYNY | 173 | LGS | 174 | MQALHIPGVT | 175 |

Figure 38A
CPA.7.001

| What | sequence | SEQ ID NO: |
|---|---|---|
| Variable heavy (vh) domain | QMQLVQSGAEVKKPGSSVKVSCKASGGTFSSYAISWVRQAPGQGLEWMGGIIPIFGTANYAQKFQGRVTITADESTSTAYME LSSLRSEDTAVYYCAREEVSSPYGMDVWGQGTTVTVSS | 176 |
| vhCDR1 | GGTFSSYA | 177 |
| vhCDR2 | IIPIFGTA | 178 |
| vhCDR3 | AREEVSSPYGMDV | 179 |
| Full length HC | QMQLVQSGAEVKKPGSSVKVSCKASGGTFSSYAISWVRQAPGQGLEWMGGIIPIFGTANYAQKFQGRVTITADESTSTAYME LSSLRSEDTAVYYCAREEVSSPYGMDVWGQGTTVTVSSASTKGPSVFPLAPSSKSTSGGTAALGCLVKDYFPEPVTVSWNSGAL TSGVHTFPAVLQSSGLYSLSSVVTVPSSSLGTQTYICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYNSTYRVVSVLTVLHQDWLNGKEYKCKVSNKALPAPI EKTISKAKGQPREPQVYTLPPSREEMTKNQVSLTCLVKGFYPSDIAVEWESNGQPENNYKTTPPVLDSDGSFFLYSKLTVDKSR WQQGNVFSCSVMHEALHNHYTQKSLSLSPGK | 180 |
| Variable light (vl) domain | QAVVTQEPSLTVSPGGTVTLTCGTSTGAVTSGHYPYWFQQKPGQAPKTLIYDTGNKHSWTPARFSGSLLGGKAALTLSGAQPE DEADYYCLLSYSGASWVFGGGTKLTVLG | 181 |
| vlCDR1 | TGAVTSGHY | 182 |
| vlCDR2 | DTG | 183 |
| vlCDR3 | LLSYSGASWV | 184 |
| Full length light chain | QAVVTQEPSLTVSPGGTVTLTCGTSTGAVTSGHYPYWFQQKPGQAPKTLIYDTGNKHSWTPARFSGSLLGGKAALTLSGAQPE DEADYYCLLSYSGASWVFGGGTKLTVLGQPKAAPSVTLFPPSSEELQANKATLVCLISDFYPGAVTVAWKADSSPVKAGVETTT PSKQSNNKYAASSYLSLTPEQWKSHRSYSCQVTHEGSTVEKTVAPTECS | 185 |

Figure 38B
CPA.7.003

| What | sequence | SEQ ID NO: |
|---|---|---|
| Variable heavy (vh) domain | QVQLVQSGAEVKKPGASVKVSCKVSGFSLSHFSMHWVRQVPGKGLEWLGGFDPEEGGTIPAQKFQGRLTMTEDTST ETAYMELSSLRSEDTAVYYCATGIWYSSGWPVDYWGPGTLVTVSS | 186 |
| vhCDR1 | GFSLSHFS | 187 |
| vhCDR2 | FDPEEGGT | 188 |
| vhCDR3 | ATGIWYSSGWPVDY | 189 |
| Full length HC | EVQLVQSGAEVKKPGSSVKVSCKASGGTFSSYAISWVRQAPGQGLEWMGGIPIFGTANYAQKFQGRVTITADKSTST AYMELSSLRSEDTAVYYCARGPWYYDSSGYSSYAYYMDVWGQGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSGSFFLYSKLTVDKSRWQQGNVFSCSVMHEALHNHYTQKSLSLSPGK | 190 |
| Variable light (vl) domain | DVVMTQSPLSLPVTPGGPASISCRSSQSLLDSSGYNYVDWYLQKPGQSPQLLISLGSDRASGVPDRFSGSGSGTDFTLKI SRVEAEDVGIYYCMQALQTPITFGQGTRLEIKR | 191 |
| vlCDR1 | QSLLDSSGYNY | 192 |
| vlCDR2 | LGS | 193 |
| vlCDR3 | MQALQTPIT | 194 |
| Full length light chain | DVVMTQSPLSLPVTPGGPASISCRSSQSLLDSSGYNYVDWYLQKPGQSPQLLISLGSDRASGVPDRFSGSGSGTDFTLKI SRVEAEDVGIYYCMQALQTPITFGQGTRLEIKRTVAAPSVFIFPPSDEQLKSGTASVVCLLNNFYPREAKVQWKVDNAL QSGNSQESVTEQDSKDSTYSLSSTLTLSKADYEKHKVYACEVTHQGLSSPVTKSFNRGEC | 195 |

Figure 38C
CPA.7.004

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATVSRVRGVINYYYYMDV WGKGTTVTVSS | 196 |
| vhCDR1 | GYTLTELS | 197 |
| vhCDR2 | FDPEDGET | 198 |
| vhCDR3 | ATVSRVRGVINYYYYMDV | 199 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATVSRVRGVINYYYYMDVWGKGTTVTVSSASTKGPSVFPLAPSSKSTSGGTAALGCLV KDYFPEPVTVSWNSGALTSGVHTFPAVLQSSGLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVMHEALHNHYTQKSLSLSPGK | 200 |
| Variable light (vl) domain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKR | 201 |
| vlCDR1 | QSLLYRNGNNY | 202 |
| vlCDR2 | LGS | 203 |
| vlCDR3 | MQALQTPPT | 204 |
| Full length light chain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 205 |

Figure 38D
CPA.7.006

| What | sequence | SEQ ID NO: |
|---|---|---|
| Variable heavy (vh) domain | QVQLVQSGAEVRRPGSSVRVSCKPSGGTFGTYAFTWVRQAPGQGLEWMGGITPISATINRAQNLQDRLTITADESTT TVHMDLTSLRSEDTAVYYCARGFEYSDGLLDDWGQGTLVTVSS | 206 |
| vhCDR1 | GGTFGTYA | 207 |
| vhCDR2 | ITPISATI | 208 |
| vhCDR3 | ARGFEYSDGLLDD | 209 |
| Full length HC | QVQLVQSGAEVRRPGSSVRVSCKPSGGTFGTYAFTWVRQAPGQGLEWMGGITPISATINRAQNLQDRLTITADESTT TVHMDLTSLRSEDTAVYYCARGFEYSDGLLDDWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPSNTKVDKKVEPKSCDKTHTCPPCPAP ELLGGPSVFLFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLSPGK | 210 |
| Variable light (vl) domain | DIVMTQTPLSLPVIPGEPASISCRSSQSLFYSDDGNTYLDWYLQKPGQSPQLLIYRLSHRASGVPDRFSGSGSGTDFTLKI SRVEAEDVGVYYCMQHMEFPLTFGGGTKVEIKR | 211 |
| vlCDR1 | QSLFYSDDGNTY | 212 |
| vlCDR2 | RLS | 213 |
| vlCDR3 | MQHMEFPLT | 214 |
| Full length light chain | DIVMTQTPLSLPVIPGEPASISCRSSQSLFYSDDGNTYLDWYLQKPGQSPQLLIYRLSHRASGVPDRFSGSGSGTDFTLKI SRVEAEDVGVYYCMQHMEFPLTFGGGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 215 |

Figure 38E
CPA.7.008

| What | sequence | SEQ ID NO: |
|---|---|---|
| Variable heavy (vh) domain | QVQLQESGPGLVKPSGTLSLTCVVSSGSISSTNWWTWVRQPPGKGLEWIGEIYHSGSTSYNSSLKSRVTISEDKSKNQIS LRLSSVTAADTAVYYCARVGPAAIYYWGQGTLVTVSS | 216 |
| vhCDR1 | SGSISSTNW | 217 |
| vhCDR2 | IYHSGST | 218 |
| vhCDR3 | ARVGPAAIYY | 219 |
| Full length HC | QVQLQESGPGLVKPSGTLSLTCVVSSGSISSTNWWTWVRQPPGKGLEWIGEIYHSGSTSYNSSLKSRVTISEDKSKNQIS LRLSSVTAADTAVYYCARVGPAAIYYWGQGTLVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKKVEPKSCDKTHTCPPCPAPELLGGPS VFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGK | 220 |
| Variable light (vl) domain | QAGLTQPPSVSKGLRQTATLTCTGNSNNVGYEGAAWLQQHQGHAPKLLLYRNNNRPSGISKRFSASRSGNTASLTITG LQPEDEADYYCSAWDSSLNAVVFGGGTQLTVLG | 221 |
| vlCDR1 | SNNVGYEG | 222 |
| vlCDR2 | RNN | 223 |
| vlCDR3 | SAWDSSLNAVV | 224 |
| Full length light chain | QAGLTQPPSVSKGLRQTATLTCTGNSNNVGYEGAAWLQQHQGHAPKLLLYRNNNRPSGISKRFSASRSGNTASLTITG LQPEDEADYYCSAWDSSLNAVVFGGGTQLTVLGQPKAAPSVTLFPPSSEELQANKATLVCLISDFYPGAVTVAWKADS SPVKAGVETTTPSKQSNNKYAASSYLSLTPEQWKSHRSYSCQVTHEGSTVEKTVAPTECS | 225 |

Figure 38F
CPA.7.009

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAKPGIAVAGQNYYYYMDVWGKGTTVTVSS | 226 |
| vhCDR1 | GYTLTELS | 227 |
| vhCDR2 | FDPEDGET | 228 |
| vhCDR3 | ATAKPGIAVAGQNYYYYMDV | 229 |
| Full length HC | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAKPGIAVAGQNYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 230 |
| Variable light (vl) domain | DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKR | 231 |
| vlCDR1 | QSLLYRNGNNY | 232 |
| vlCDR2 | LGS | 233 |
| vlCDR3 | MQALQTPPT | 234 |
| Full length light chain | DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 235 |

Figure 38G
CPA.7.010

| What | sequence | SEQ ID NO: |
|---|---|---|
| Variable heavy (vh) domain | EVQLVESGGGLVQPGRSLRLSCAASGFTFSSYAMHWVRQAPGKGLEWVAVISYDGSNKYYADSVKGRFTISRDNSKN TLYLQMNSLRAEDTAVYYCASSPIGYSYGYWGGMDVWGQGTTVTVSS | 236 |
| vhCDR1 | GFTFSSYA | 237 |
| vhCDR2 | ISYDGSNK | 238 |
| vhCDR3 | ASSPIGYSYGYWGGMDV | 239 |
| Full length HC | EVQLVESGGGLVQPGRSLRLSCAASGFTFSSYAMHWVRQAPGKGLEWVAVISYDGSNKYYADSVKGRFTISRDNSKN TLYLQMNSLRAEDTAVYYCASSPIGYSYGYWGGMDVWGQGTTVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNTKVDKKVEPKSCDKTHTCP PCPAPELLGGPSVFLFPPKPKDTLMISRTPEVTCVVVDVSHEDPEVKFNWYVDGVEVHNAKTKPREEQYNSTYRVVSVL TVLHQDWLNGKEYKCKVSNKALPAPIEKTISKAKGQPREPQVYTLPPSREEMTKNQVSLTCLVKGFYPSDIAVEWESNG QPENNYKTTPPVLDSDGSFFLYSKLTVDKSRWQQGNVFSCSVMHEALHNHYTQKSLSLSPGK | 240 |
| Variable light (vl) domain | QAVLTQPASLSASPGASASLTCTLRSGIDVRTNKIFWYQVKPGSPPQHLLTFQSDSDKQQGSGVPSRFSGSKDASANA GILIISGLQSEDEADYYCLIWHTSGWVFGGGTQLTVLG | 241 |
| vlCDR1 | SGIDVRTNK | 242 |
| vlCDR2 | FQSDSDK | 243 |
| vlCDR3 | LIWHTSGWV | 244 |
| Full length light chain | QAVLTQPASLSASPGASASLTCTLRSGIDVRTNKIFWYQVKPGSPPQHLLTFQSDSDKQQGSGVPSRFSGSKDASANA GILIISGLQSEDEADYYCLIWHTSGWVFGGGTQLTVLGQPKAAPSVTLFPPSSEELQANKATLVCLISDFYPGAVTVAWK ADSSPVKAGVETTTPSKQSNNKYAASSYLSLTPEQWKSHRSYSCQVTHEGSTVEKTVAPTECS | 245 |

Figure 38H
CPA.7.01.1

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGPAAAGVGYYYMDV WGKGTTVTVSS | 246 |
| vhCDR1 | GYTLTELS | 247 |
| vhCDR2 | FDPEDGET | 248 |
| vhCDR3 | ATGPAAAGVGYYYMDV | 249 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGPAAAGVGYYYMDVWGKGTTVTVSSASTKGPSVFPLAPSSKSTSGTAALGCLV KDYFPEPVTVSWNSGALTSGVHTFPAVLQSSGLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVMHEALHNHYTQKSLSLSPGK | 250 |
| Variable light (vl) domain | DVVMTQSPLSLPVTPGEPASISCRSSQSLLYRNGYNYLDWYLQKPGQSPQLLIYLGSNRASGVPDRFSGSGSGTDFTLKI SRVEAEDVGVYYCMQALQTPPTFGQGTKVEIKR | 251 |
| vlCDR1 | QSLLYRNGYNY | 252 |
| vlCDR2 | LGS | 253 |
| vlCDR3 | MQALQTPPT | 254 |
| Full length light chain | DVVMTQSPLSLPVTPGEPASISCRSSQSLLYRNGYNYLDWYLQKPGQSPQLLIYLGSNRASGVPDRFSGSGSGTDFTLKI SRVEAEDVGVYYCMQALQTPPTFGQGTKVEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 255 |

Figure 381
CPA7.012

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYDGSNKYYADSVKGRFTISRDNSKNT LYLQMNSLRAEDTAVYYCARDVMVYCSSTSCYFYGMDVWGQGTTVTVSS | 256 |
| vhCDR1 | GFTFSSYA | 257 |
| vhCDR2 | ISYDGSNK | 258 |
| vhCDR3 | ARDVMVYCSSTSCYFYGMDV | 259 |
| Full length HC | EVQLVETGGGLIQPGRSLRLSCAASGFTFSSYAMHWVRQAPGKGLEWVAVISYDGSNKYYADSVKGRFTISRDNSKNT LYLQMNSLRAEDTAVYYCARDVMVYCSSTSCYFYGMDVWGQGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 260 |
| Variable light (vl) domain | DIQMTQSPSSLSASVGDRVTVTCQASQDIRDYLNWYQQKPGKAPKLLIYDASNLEAGVPSRFSGSGSGTDFTFTISGLQ PEDVATYYCQQFENLPITFGQGTRLEIKR | 261 |
| vlCDR1 | QDIRDY | 262 |
| vlCDR2 | DAS | 263 |
| vlCDR3 | QQFENLPIT | 264 |
| Full length light chain | DIQMTQSPSSLSASVGDRVTVTCQASQDIRDYLNWYQQKPGKAPKLLIYDASNLEAGVPSRFSGSGSGTDFTFTISGLQ PEDVATYYCQQFENLPITFGQGTRLEIKRTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRGEC | 265 |

Figure 38J
CPA.7.013

| What | sequence | SEQ ID NO: |
|---|---|---|
| Variable heavy (vh) domain | QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSSGFNYYYYMDV WGKGTTVTVSS | 266 |
| vhCDR1 | GYTLTELS | 267 |
| vhCDR2 | FDPEDGET | 268 |
| vhCDR3 | ATGGYSSGFNYYYYMDV | 269 |
| Full length HC | QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSSGFNYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 270 |
| Variable light (vl) domain | DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKR | 271 |
| vlCDR1 | QSLLYRNGNNY | 272 |
| vlCDR2 | LGS | 273 |
| vlCDR3 | MQALQTPPT | 274 |
| Full length light chain | DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 275 |

Figure 38K
CPA.7.014

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETYAQKFQGRVTMTEDTS TDTAYMELSSLRSEDTAVYYCATGVTTYYYGMDVWGQGTTVTVSS | 276 |
| vhCDR1 | GYTLTELS | 277 |
| vhCDR2 | FDPEDGET | 278 |
| vhCDR3 | ATGVTTYYYGMDV | 279 |
| Full length HC | EVQLVQSGAEVKKPGASVKVSCKVSGYTLTELSMHWVRQAPGKGLEWMGGFDPEDGETYAQKFQGRVTMTEDTS TDTAYMELSSLRSEDTAVYYCATGVTTYYYGMDVWGQGTTVTVSSASTKGPSVFPLAPSSKSTSGGTAALGCLVKDY FPEPVTVSWNSGALTSGVHTFPAVLQSSGLYSLSSVVTVPSSSLGTQTYICNVNHKPSNTKVDKKVEPKSCDKTHTCPPC PAPELLGGPSVFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK | 280 |
| Variable light (vl) domain | DVVMTQSPLSLPVTPGEPASISCRSSQSLLYSNGNNFLDWYLQKPGQSPRLLISLGSNRASGVPDRFSGSGSGTDFTLKI SRVEAEDVGIYYCMQALQTPPTFGQGTKVEIKR | 281 |
| vlCDR1 | QSLLYSNGNNF | 282 |
| vlCDR2 | LGS | 283 |
| vlCDR3 | MQALQTPPT | 284 |
| Full length light chain | DVVMTQSPLSLPVTPGEPASISCRSSQSLLYSNGNNFLDWYLQKPGQSPRLLISLGSNRASGVPDRFSGSGSGTDFTLKI SRVEAEDVGIYYCMQALQTPPTFGQGTKVEIKRTVAAPSVFIFPPSDEQLKSGTASVVCLLNNFYPREAKVQWKVDNAL QSGNSQESVTEQDSKDSTYSLSSTLTLSKADYEKHKVYACEVTHQGLSSPVTKSFNRGEC | 285 |

Figure 38L
CPA.7.015

| What | sequence | SEQ ID NO: |
|---|---|---|
| Variable heavy (vh) domain | QITLKESGGGVVQPGGSLRLSCAASGFTFSSYGMHWVRQAPGKGLEWVAFIRYDGSNKYYADSVKGRFTISRDNSKN TLYLQMNSLRAEDTAVYYCARDLFDFWWDGMDVWGQGTTVTVSS | 286 |
| vhCDR1 | GFTFSSYG | 287 |
| vhCDR2 | IRYDGSNK | 288 |
| vhCDR3 | ARDLFDFWWDGMDV | 289 |
| Full length HC | QITLKESGGGVVQPGGSLRLSCAASGFTFSSYGMHWVRQAPGKGLEWVAFIRYDGSNKYYADSVKGRFTISRDNSKN TLYLQMNSLRAEDTAVYYCARDLFDFWWDGMDVWGQGTTVTVSSASTKGPSVFPLAPSSKSTSGGTAALGCLVKDY FPEPVTVSWNSGALTSGVHTFPAVLQSSGLYSLSSVVTVPSSSLGTQTYICNVNHKPSNTKVDKKVEPKSCDKTHTCPPC PAPELLGGPSVFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK | 290 |
| Variable light (vl) domain | EIVLTQSPGTLSLSPGEKATLSCRVSQSVSSMYLAWYQQKPGQAPRLLIYGASYRATGIPDRFSGSGSGTDFNLTISRLEP EDFAVYYCQQYVSSPMYTFGLGTKLEIKR | 291 |
| vlCDR1 | QSVSSMY | 292 |
| vlCDR2 | GAS | 293 |
| vlCDR3 | QQYVSSPMYT | 294 |
| Full length light chain | EIVLTQSPGTLSLSPGEKATLSCRVSQSVSSMYLAWYQQKPGQAPRLLIYGASYRATGIPDRFSGSGSGTDFNLTISRLEP EDFAVYYCQQYVSSPMYTFGLGTKLEIKRTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRGEC | 295 |

Figure 38M
CPA.7.017

| What | sequence | SEQ ID NO: |
|---|---|---|
| Variable heavy (vh) domain | QVQLVQSGAEVKKPGSSVKVSCKASGGTFNNYGISWVRQAPGKGLEWMGQIIPLFGTTKYAQKFQGRVTIAADEPTS TAYMELGSLRSEDTAIYYCARDRMAADGMAVFDYWGQGTLVTVSS | 296 |
| vhCDR1 | GGTFNNYG | 297 |
| vhCDR2 | IIPLFGTT | 298 |
| vhCDR3 | ARDRMAADGMAVFDY | 299 |
| Full length HC | QVQLVQSGAEVKKPGSSVKVSCKASGGTFNNYGISWVRQAPGKGLEWMGQIIPLFGTTKYAQKFQGRVTIAADEPTS TAYMELGSLRSEDTAIYYCARDRMAADGMAVFDYWGQGTLVTVSSASTKGPSVFPLAPSSKSTSGGTAALGCLVKDYF PEPVTVSWNSGALTSGVHTFPAVLQSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNWYVDGVEVHNAKTKPREEQYNSTYRVVSVLTVL HQDWLNGKEYKCKVSNKALPAPIEKTISKAKGQPREPQVYTLPPSREEMTKNQVSLTCLVKGFYPSDIAVEWESNGQP ENNYKTTPPVLDSDGSFFLYSKLTVDKSRWQQGNVFSCSVMHEALHNHYTQKSLSLSPGK | 300 |
| Variable light (vl) domain | QSVLTQPPSVSGTPGQKVIISCSGSSSNIGRHFVFWYQQLPGTAPKLLIYKNDERPSGVPDRFSGSKSGTSASLAVSGLRS EDEADYYCSSWDAALNGVVFGGGTKLTVLG | 301 |
| vlCDR1 | SSNIGRHF | 302 |
| vlCDR2 | KND | 303 |
| vlCDR3 | SSWDAALNGVV | 304 |
| Full length light chain | QSVLTQPPSVSGTPGQKVIISCSGSSSNIGRHFVFWYQQLPGTAPKLLIYKNDERPSGVPDRFSGSKSGTSASLAVSGLRS EDEADYYCSSWDAALNGVVFGGGTKLTVLGQPKAAPSVTLFPPSSEELQANKATLVCLISDFYPGAVTVAWKADSSPV KAGVETTTPSKQSNNKYAASSYLSLTPEQWKSHRSYSCQVTHEGSTVEKTVAPTECS | 305 |

Figure 38N
CPA.7.018

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVPMVRGARRYYYYMDVWGKGTTVTVSS | 306 |
| vhCDR1 | GYTLTELS | 307 |
| vhCDR2 | FDPEDGET | 308 |
| vhCDR3 | ATEVPMVRGARRYYYYMDV | 309 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVPMVRGARRYYYYMDVWGKGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 310 |
| Variable light (vl) domain | DVVMTQSPLFLAVTPGEPASISCRSSQTLLYINENNYLDWYVQKPGQSPQLLIYLGSTRASGVPDRFSGGGSGTDFTLTI SRVEAEDVGLYYCMQGLQTPPTFGQGTRLEIKR | 311 |
| vlCDR1 | QTLLYINENNY | 312 |
| vlCDR2 | LGS | 313 |
| vlCDR3 | MQGLQTPPT | 314 |
| Full length light chain | DVVMTQSPLFLAVTPGEPASISCRSSQTLLYINENNYLDWYVQKPGQSPQLLIYLGSTRASGVPDRFSGGGSGTDFTLTI SRVEAEDVGLYYCMQGLQTPPTFGQGTRLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 315 |

Figure 380
CPA.7.019

| What | sequence | SEQ ID NO: |
|---|---|---|
| Variable heavy (vh) domain | QVQLQESGPGLVKSSETLSLTCSVSGGSISNSNYYWGWIRQPPGKGLEWIGGIYYSGSTYYNPSLESRVTISEDTSKNQIS LKLSSVTAADTAVYYCARGAWELSLGDWFDPWGPGTLVTVSS | 316 |
| vhCDR1 | GGSISNSNYY | 317 |
| vhCDR2 | IYYSGST | 318 |
| vhCDR3 | ARGAWELSLGDWFDP | 319 |
| Full length HC | QVQLQESGPGLVKSSETLSLTCSVSGGSISNSNYYWGWIRQPPGKGLEWIGGIYYSGSTYYNPSLESRVTISEDTSKNQIS LKLSSVTAADTAVYYCARGAWELSLGDWFDPWGPGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPSNTKVDKKVEPKSCDKTHTCPPCPAP ELLGGPSVFLFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLSPGK | 320 |
| Variable light (vl) domain | QSVLTQPPSVSGAPGQRVTISCTGSSSNIGAGYDIQWYQQLPGTAPKLLIYGNNNRPSGVPDRFSGSRSGTSASLAITGL QAEDEADYYCQSYDSSLSVYVVFGGGTQLTVLG | 321 |
| vlCDR1 | SSNIGAGYD | 322 |
| vlCDR2 | GNN | 323 |
| vlCDR3 | QSYDSSLSVYVV | 324 |
| Full length light chain | QSVLTQPPSVSGAPGQRVTISCTGSSSNIGAGYDIQWYQQLPGTAPKLLIYGNNNRPSGVPDRFSGSRSGTSASLAITGL QAEDEADYYCQSYDSSLSVYVVFGGGTQLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS | 325 |

Figure 38P
CPA.7.021

| What | sequence | SEQ ID NO: |
|---|---|---|
| Variable heavy (vh) domain | EVQLVESGGGVVKPGGSLRLSCAASGFTFGTSSMNWVRQAPGKGLEWVAVISFDGTEIHYADSVKGRFTISRDNSKST VFLQMNSLRPDDTALYYCAKGSGNIYFYSGMDVWGQGTTVTVSS | 326 |
| vhCDR1 | GFTFGTSS | 327 |
| vhCDR2 | ISFDGTEI | 328 |
| vhCDR3 | AKGSGNIYFYSGMDV | 329 |
| Full length HC | EVQLVESGGGVVKPGGSLRLSCAASGFTFGTSSMNWVRQAPGKGLEWVAVISFDGTEIHYADSVKGRFTISRDNSKST VFLQMNSLRPDDTALYYCAKGSGNIYFYSGMDVWGQGTTVTVSSASTKGPSVFPLAPSSKSTSGGTAALGCLVKDYFP EPVTVSWNSGALTSGVHTFPAVLQSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNWYVDGVEVHNAKTKPREEQYNSTYRVVSVLTVL HQDWLNGKEYKCKVSNKALPAPIEKTISKAKGQPREPQVYTLPPSREEMTKNQVSLTCLVKGFYPSDIAVEWESNGQP ENNYKTTPPVLDSDGSFFLYSKLTVDKSRWQQGNVFSCSVMHEALHNHYTQKSLSLSPGK | 330 |
| Variable light (vl) domain | DIQMTQSPSTLSASVGDRVTITCRAGQSISGWLAWFQQKPGKAPNLLIYETSTLESGVPSRFSGSGSGTEYTLTISSLQP DDFATYYCQQYYSYPLTFGQGTKVEIKR | 331 |
| vlCDR1 | QSISGW | 332 |
| vlCDR2 | ETS | 333 |
| vlCDR3 | QQYYSYPLT | 334 |
| Full length light chain | DIQMTQSPSTLSASVGDRVTITCRAGQSISGWLAWFQQKPGKAPNLLIYETSTLESGVPSRFSGSGSGTEYTLTISSLQP DDFATYYCQQYYSYPLTFGQGTKVEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 335 |

Figure 38Q
CAP.7.022

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGVPAAIGVYYYYYMDVWGKGTTVTVSS | 336 |
| vhCDR1 | GYTLTELS | 337 |
| vhCDR2 | FDPEDGET | 338 |
| vhCDR3 | ATGVPAAIGVYYYYYMDV | 339 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGVPAAIGVYYYYYMDVWGKGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 340 |
| Variable light (vl) domain | DVVMTQSPLSLPVTPGEPASISCRSSQSLLYSNGYNYLDWYLQKPGQSPQLLISLGSNRASGVPDRFSGSGSGTDFTLKI SRVEAEDVGVYYCMQALQSPVTFGGGTKVEIKR | 341 |
| vlCDR1 | QSLLYSNGYNY | 342 |
| vlCDR2 | LGS | 343 |
| vlCDR3 | MQALQSPVT | 344 |
| Full length light chain | DVVMTQSPLSLPVTPGEPASISCRSSQSLLYSNGYNYLDWYLQKPGQSPQLLISLGSNRASGVPDRFSGSGSGTDFTLKI SRVEAEDVGVYYCMQALQSPVTFGGGTKVEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 345 |

Figure 38R
CPA.7.023

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATDSRDGPAARGGYYYYMDVWGQGTTVTVSS | 346 |
| vhCDR1 | GYTLTELS | 347 |
| vhCDR2 | FDPEDGET | 348 |
| vhCDR3 | ATDSRDGPAARGGYYYYMDV | 349 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATDSRDGPAARGGYYYYMDVWGQGTTVTVSSASTKGPSVFPLAPSSKSTSGGTAALG CLVKDYFPEPVTVSWNSGALTSGVHTFPAVLQSSGLYSLSSVVTVPSSSLGTQTYICNVNHKPSNTKVDKKVEPKSCDKT HTCPPCPAPELLGGPSVFLFPPKPKDTLMISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVVTLPPSREEMTKNQVSLTCLVKGFYPSDIAVE WESNGQPENNYKTTPPVLDSDGSFFLYSKLTVDKSRWQQGNVFSCSVMHEALHNHYTQKSLSLSPGK | 350 |
| Variable light (vl) domain | DVVMTQSPLSLPVTLGQPASISCRSSQSLLYINGYNYLDWYLQKPGQSPQLLIYLGSNRASGVPDRFSGSGSGTDFTLKI SRVEAEDVGVYYCMQALQTPPTFGQGTKVEIKR | 351 |
| vlCDR1 | QSLLYINGYNY | 352 |
| vlCDR2 | LGS | 353 |
| vlCDR3 | MQALQTPPT | 354 |
| Full length light chain | DVVMTQSPLSLPVTLGQPASISCRSSQSLLYINGYNYLDWYLQKPGQSPQLLIYLGSNRASGVPDRFSGSGSGTDFTLKI SRVEAEDVGVYYCMQALQTPPTFGQGTKVEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 355 |

Figure 385
CPA.7.024

| What | sequence | SEQ ID NO: |
|---|---|---|
| Variable heavy (vh) domain | EVQLVQSGAEVKKPGSSVKVSCKASGGTFSSYAISWVRQAPGQGLEWMGGIIPIFGTANYAQKFQGRVTITADESTST AYMELSSLRSEDTAVYYCARDAYYYDSSGYYNPDAFDIWGQGTMVTVSS | 356 |
| vhCDR1 | GGTFSSYA | 357 |
| vhCDR2 | IIPIFGTA | 358 |
| vhCDR3 | ARDAYYYDSSGYYNPDAFDI | 359 |
| Full length HC | EVQLVQSGAEVKKPGSSVKVSCKASGGTFSSYAISWVRQAPGQGLEWMGGIIPIFGTANYAQKFQGRVTITADESTST AYMELSSLRSEDTAVYYCARDAYYYDSSGYYNPDAFDIWGQGTMVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNTKVDKKVEPKSCDKTHTCP PCPAPELLGGPSVFLFPPKPKDTLMISRTPEVTCVVVDVSHEDPEVKFNWYVDGVEVHNAKTKPREEQYNSTYRVVSVL TVLHQDWLNGKEYKCKVSNKALPAPIEKTISKAKGQPREPQVYTLPPSREEMTKNQVSLTCLVKGFYPSDIAVEWESNG QPENNYKTTPPVLDSDGSFFLYSKLTVDKSRWQQGNVFSCSVMHEALHNHYTQKSLSLSPGK | 360 |
| Variable light (vl) domain | DVVMTQSPLSLPVTPGEPASISCRSSQSLLHSNGYNYLDWYLQKPGQSPQLLIYLGSSRASGVPDRFSGSVSGTDFTLKI SRVEAEDVGVYYCMQGLQTPRTFGRGTKLEIKR | 361 |
| vlCDR1 | QSLLHSNGYNY | 362 |
| vlCDR2 | LGS | 363 |
| vlCDR3 | MQGLQTPRT | 364 |
| Full length light chain | DVVMTQSPLSLPVTPGEPASISCRSSQSLLHSNGYNYLDWYLQKPGQSPQLLIYLGSSRASGVPDRFSGSVSGTDFTLKI SRVEAEDVGVYYCMQGLQTPRTFGRGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 365 |

Figure 38T

CPA.7.033

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 366 |
| vhCDR1 | GGTFSSSA | 367 |
| vhCDR2 | IIPIYGIT | 368 |
| vhCDR3 | ARDDTARRVRGVPYYYYAMDV | 369 |
| Full length HC | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 370 |
| Variable light (vl) domain | ETTLTQSPAFMSATPGDEVNISCKASQDIDDDVSWYQQKPGGAPIFLIQEASTLVPGIPPRFSGSGFGTDFTLTIKNMES EDAAYYFCLQHDNLPLTFGGGTKVDIKR | 371 |
| vlCDR1 | QDIDDD | 372 |
| vlCDR2 | EAS | 373 |
| vlCDR3 | LQHDNLPLT | 374 |
| Full length light chain | ETTLTQSPAFMSATPGDEVNISCKASQDIDDDVSWYQQKPGGAPIFLIQEASTLVPGIPPRFSGSGFGTDFTLTIKNMES EDAAYYFCLQHDNLPLTFGGGTKVDIKRTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRGEC | 375 |

Figure 38U

CPA.7.034

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSLRSEDTAVYYCATEDPGPVAGPYYYYGMDVWGQGTTVTVSS | 376 |
| vhCDR1 | GYTLTELS | 377 |
| vhCDR2 | FDPEDGET | 378 |
| vhCDR3 | ATEDPGPVAGPYYYYGMDV | 379 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSLRSEDTAVYYCATEDPGPVAGPYYYYGMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 380 |
| Variable light (vl) domain | DVVMTQSPLVLPVTPGEPASISCRSSQSLLYINGYHYLDWYVQRPGQSPQLLIFLGSTRASGVPDRFSGSGSGTDFTLEIS KVEAEDVGIYFCMQALQTPPTFGGGTKVEIKR | 381 |
| vlCDR1 | QSLLYINGYHY | 382 |
| vlCDR2 | LGS | 383 |
| vlCDR3 | MQALQTPPT | 384 |
| Full length light chain | DVVMTQSPLVLPVTPGEPASISCRSSQSLLYINGYHYLDWYVQRPGQSPQLLIFLGSTRASGVPDRFSGSGSGTDFTLEIS KVEAEDVGIYFCMQALQTPPTFGGGTKVEIKRTVAAPSVFIFPPSDEQLKSGTASVVCLLNNFYPREAKVQWKVDNAL QSGNSQESVTEQDSKDSTYSLSSTLTLSKADYEKHKVYACEVTHQGLSSPVTKSFNRGEC | 385 |

Figure 38V

CPA.7.036

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 386 |
| vhCDR1 | GGTFSSSA | 387 |
| vhCDR2 | IIPIYGIT | 388 |
| vhCDR3 | ARDDTARRVRGVPYYYYAMDV | 389 |
| Full length HC | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 390 |
| Variable light (vl) domain | DIVMTQTPLSLPVTPGEPASISCRPSQSLLDSDDGNTYLDWYLQKPGQSPQLLIHTLSYRASGVPDRFSGSGSGTDFTLKI SRVEAEDVGVYYCMQRLQFPLTFGGGTKVEIKR | 391 |
| vlCDR1 | QSLLDSDDGNTY | 392 |
| vlCDR2 | TLS | 393 |
| vlCDR3 | MQRLQFPLT | 394 |
| Full length light chain | DIVMTQTPLSLPVTPGEPASISCRPSQSLLDSDDGNTYLDWYLQKPGQSPQLLIHTLSYRASGVPDRFSGSGSGTDFTLKI SRVEAEDVGVYYCMQRLQFPLTFGGGTKVEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 395 |

Figure 38W

CPA.7.040

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGVPAAIGVYYYYMDVWGKGTTVTVSS | 396 |
| vhCDR1 | GYTLTELS | 397 |
| vhCDR2 | FDPEDGET | 398 |
| vhCDR3 | ATGVPAAIGVYYYYMDV | 399 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGVPAAIGVYYYYMDVWGKGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 400 |
| Variable light (vl) domain | DVVMTQSPLSLPVTPGEPASISCRSSQSLLYRNGYNYLDWYLQKPGQSPQLLIYWGSYRASGVPDRFSGSGSGTDFTLK ISRVEAEDVGVYYCMQAVQNPPTFGQGTKVDIKR | 401 |
| vlCDR1 | QSLLYRNGYNY | 402 |
| vlCDR2 | WGS | 403 |
| vlCDR3 | MQAVQNPPT | 404 |
| Full length light chain | DVVMTQSPLSLPVTPGEPASISCRSSQSLLYRNGYNYLDWYLQKPGQSPQLLIYWGSYRASGVPDRFSGSGSGTDFTLK ISRVEAEDVGVYYCMQAVQNPPTFGQGTKVDIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 405 |

Figure 38X

CPA.7.046

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGIITDYAQKFQGRVTITTDESTST AYMELSSLTSEDTAVYYCARDDTARRVRGVPYYYYAMDVWGQGTTVTVSS | 406 |
| vhCDR1 | GGTFSSSA | 407 |
| vhCDR2 | IIPIYGIIT | 408 |
| vhCDR3 | ARDDTARRVRGVPYYYYAMDV | 409 |
| Full length HC | QVQLVQSGAEVKKPGSSVKVSCKASGGTFSSSAISWVRQAPGQGFEWMGGIIPIYGIITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 410 |
| Variable light (vl) domain | DVVMTQSPAFLSVTPGERVTLSCKASQTMNNYLAWYQQKPGQAPRLLIYDASTRATDTPPRFSGSGSGTEFTLTISSV QSEDFALYYCQQYGDWLPITFGQGTRLEIKR | 411 |
| vlCDR1 | QTMNNY | 412 |
| vlCDR2 | DAS | 413 |
| vlCDR3 | QQYGDWLPIT | 414 |
| Full length light chain | DVVMTQSPAFLSVTPGERVTLSCKASQTMNNYLAWYQQKPGQAPRLLIYDASTRATDTPPRFSGSGSGTEFTLTISSV QSEDFALYYCQQYGDWLPITFGQGTRLEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFNRGEC | 415 |

Figure 38Y

CPA.7.047

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATAFPEATISYYYYMDVWGKGTTVTVSS | 416 |
| vhCDR1 | GYTLTELS | 417 |
| vhCDR2 | FDPEDGET | 418 |
| vhCDR3 | ATAFPEATISYYYYMDV | 419 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATAFPEATISYYYYMDVWGKGTTVTVSSASTKGPSVFPLAPSSKSTSGGTAALGCLVKD YFPEPVTVSWNSGALTSGVHTFPAVLQSSGLYSLSSVVTVPSSSLGTQTYICNVNHKPSNTKVDKKVEPKSCDKTHTCPP CPAPELLGGPSVFLFPPKPKDTLMISRTPEVTCVVVDVSHEDPEVKFNWYVDGVEVHNAKTKPREEQYNSTYRVVSVLT VLHQDWLNGKEYKCKVSNKALPAPIEKTISKAKGQPREPQVYTLPPSREEMTKNQVSLTCLVKGFYPSDIAVEWESNG QPENNYKTTPPVLDSDGSFFLYSKLTVDKSRWQQGNVFSCSVMHEALHNHYTQKSLSLSPGK | 420 |
| Variable light (vl) domain | DVVMTQSPLSLPVTPGEPASISCRSSQSLLYRNGYNYLDWYLQKPGQSPQLLIYWGSYRASGVPDRFSGSGSGTDFTLK ISRVEAEDVGVYYCMQAVQNPPTFGQGTKVEIKR | 421 |
| vlCDR1 | QSLLYRNGYNY | 422 |
| vlCDR2 | WGS | 423 |
| vlCDR3 | MQAVQNPPT | 424 |
| Full length light chain | DVVMTQSPLSLPVTPGEPASISCRSSQSLLYRNGYNYLDWYLQKPGQSPQLLIYWGSYRASGVPDRFSGSGSGTDFTLK ISRVEAEDVGVYYCMQAVQNPPTFGQGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 425 |

Figure 38Z

CPA.7.049

| What | sequence | SEQ ID NO: |
|---|---|---|
| Variable heavy (vh) domain | QMQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 426 |
| vhCDR1 | GGTFSSSA | 427 |
| vhCDR2 | IIPIYGIT | 428 |
| vhCDR3 | ARDDTARRVRGVPYYYYAMDV | 429 |
| Full length HC | QMQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 430 |
| Variable light (vl) domain | DIVMTQTPLSLPVTPGEPASMSCRSSRSLLDSDDGNTHLDWYLQKPGQSPQLLIQSLSYRASGVPDRFSGSGSGTDFTL EISRVEAEDVGIYYCMQRKEFPLTFGGGTKVEIKR | 431 |
| vlCDR1 | RSLLDSDDGNTH | 432 |
| vlCDR2 | SLS | 433 |
| vlCDR3 | MQRKEFPLT | 434 |
| Full length light chain | DIVMTQTPLSLPVTPGEPASMSCRSSRSLLDSDDGNTHLDWYLQKPGQSPQLLIQSLSYRASGVPDRFSGSGSGTDFTL EISRVEAEDVGIYYCMQRKEFPLTFGGGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 435 |

Figure 38AA

CPA.7.050

| What | sequence | SEQ ID NO: |
|---|---|---|
| Variable heavy (vh) domain | EVQLVQSGAEVKKPGSSVKVSCKASGGTFSSYAISWVRQAPGQGLEWMGGIIPIFGTANYAQKFQGRVTITADKSTST AYMELSSLRSEDTAVYYCARGPWYYDSSGYSSYAYYMDVWGQGTTVTVSS | 436 |
| vhCDR1 | GGTFSSYA | 437 |
| vhCDR2 | IIPIFGTA | 438 |
| vhCDR3 | ARGPWYYDSSGYSSYAYYMDV | 439 |
| Full length HC | EVQLVQSGAEVKKPGSSVKVSCKASGGTFSSYAISWVRQAPGQGLEWMGGIIPIFGTANYAQKFQGRVTITADKSTST AYMELSSLRSEDTAVYYCARGPWYYDSSGYSSYAYYMDVWGQGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 440 |
| Variable light (vl) domain | DVVMTQSPLSLPVTPGEPASISCRSSQSLLHSDGYNYLDWYLQKPGQSPQLLIYLGSNRASGVPDRFSGSGSGTDFTLKI SRVEAEDVGVYYCMQALHTPGVTFGGGTKVEIKR | 441 |
| vlCDR1 | QSLLHSDGYNY | 442 |
| vlCDR2 | LGS | 443 |
| vlCDR3 | MQALHTPGVT | 444 |
| Full length light chain | DVVMTQSPLSLPVTPGEPASISCRSSQSLLHSDGYNYLDWYLQKPGQSPQLLIYLGSNRASGVPDRFSGSGSGTDFTLKI SRVEAEDVGVYYCMQALHTPGVTFGGGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 445 |

Figure 39A
CPA.7.028

| What | sequence | SEQ ID NO: |
|---|---|---|
| Variable heavy (vh) domain | QLQLQESGPGLVKPSETLSLTCTVTGGSISSSSYYWAWIRQPPGKGLEWIGGIYYSGSTYYNVSLESRVTISQDTSKNQFS LKLTSVTAADTAVYYCARGAWELRLGDWFDPWGQGTLVTVSS | 446 |
| vhCDR1 | GGSISSSYY | 447 |
| vhCDR2 | IYYSGST | 448 |
| vhCDR3 | ARGAWELRLGDWFDP | 449 |
| Full length HC | QLQLQESGPGLVKPSETLSLTCTVTGGSISSSSYYWAWIRQPPGKGLEWIGGIYYSGSTYYNVSLESRVTISQDTSKNQFS LKLTSVTAADTAVYYCARGAWELRLGDWFDPWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPSNTKVDKKVEPKSCDKTHTCPPCPAP ELLGGPSVFLFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLSPGK | 450 |
| Variable light (vl) domain | QSVLTQPPSVSGAPGQRVTISCTGSSNIGAGYDIQWYQQLPGTAPKLLIYGYSNRPSGVPDRFSGSKSGTSASLAITGL QAEDEADYYCQSYDSSLSVYVFGGGTQLTVLGQPKAA | 451 |
| vlCDR1 | SSNIGAGYD | 452 |
| vlCDR2 | GYS | 453 |
| vlCDR3 | QSYDSSLSVYV | 454 |
| Full length light chain | QSVLTQPPSVSGAPGQRVTISCTGSSNIGAGYDIQWYQQLPGTAPKLLIYGYSNRPSGVPDRFSGSKSGTSASLAITGL QAEDEADYYCQSYDSSLSVYVFGGGTQLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS | 455 |

Figure 39B
CPA.7.030

| What | sequence | SEQ ID NO: |
|---|---|---|
| Variable heavy (vh) domain | QVQLQESGGGVVQPGGSLRLSCAASRFTFEDYAMHWVRQPPGKGLEWVSGISWKSGGINYADSVKGRFTISRDNAQ NSLYLQMNSLRAEDTALYYCVKDPTLVATDRAFNIWGQGTMVTVSS | 456 |
| vhCDR1 | RFTFEDYA | 457 |
| vhCDR2 | ISWKSGGI | 458 |
| vhCDR3 | VKDPTLVATDRAFNI | 459 |
| Full length HC | QVQLQESGGGVVQPGGSLRLSCAASRFTFEDYAMHWVRQPPGKGLEWVSGISWKSGGINYADSVKGRFTISRDNAQ NSLYLQMNSLRAEDTALYYCVKDPTLVATDRAFNIWGQGTMVTVSSASTKGPSVFPLAPSSKSTSGGTAALGCLVKDY FPEPVTVSWNSGALTSGVHTFPAVLQSSGLYSLSSVVTVPSSSLGTQTYICNVNHKPSNTKVDKKVEPKSCDKTHTCPPC PAPELLGGPSVFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK | 460 |
| Variable light (vl) domain | DVVMTQSPLSLPVTPGEPASISCRSSQSLLHSNGYNYLDWYLQKPGQSPQLLIYLGSNRASGVPDRFSGSGSGTDFTLKI SRVEAEDVGVYYCMQYLQTPDTFGQGTKLEIKRAAPS | 461 |
| viCDR1 | QSLLHSNGYNY | 462 |
| viCDR2 | LGS | 463 |
| viCDR3 | MQYLQTPDT | 464 |
| Full length light chain | DVVMTQSPLSLPVTPGEPASISCRSSQSLLHSNGYNYLDWYLQKPGQSPQLLIYLGSNRASGVPDRFSGSGSGTDFTLKI SRVEAEDVGVYYCMQYLQTPDTFGQGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 465 |

Figure 39C
CPA.7.041

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 466 |
| vhCDR1 | GGTFSSSA | 467 |
| vhCDR2 | IIPIYGIT | 468 |
| vhCDR3 | ARDDTARRVRGVPYYYYAMDV | 469 |
| Full length HC | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 470 |
| Variable light (vl) domain | EIVLTQSPDFQSVTPKEKVTITCRASQNIDSSLHWYQQKPGQSPKLLINYASQSFSGVPSRFSGSGSGTDFTLTIDSLEPE DAATYFCHQSSSLPLTFGGGTKVEIRRTVAAPS | 471 |
| vlCDR1 | QNIDSS | 472 |
| vlCDR2 | YAS | 473 |
| vlCDR3 | HQSSSLPLT | 474 |
| Full length light chain | QSVLTQPPSVSGAPGQRVTISCTGSSSNIGAGYDIQWYQQLPGTAPKLLIYGYSNRPSGVPDRFSGSKSGTSASLAITGL QAEDEADYYCQSYDSSLSVYVFGGGTQLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS | 475 |

Figure 39D
CPA.7.016

| What | sequence | SEQ ID NO: |
|---|---|---|
| Variable heavy (vh) domain | EVQLVQSGAEVKKPGSSVKVSCKTSGGTFSSSAISWVRQAPGQGFEWMGGIIPIYGITDYAQKFQGRVTITTDESTSTA YMELSSLTSEDTAVYYCARDDTARRVRGVPYYYYAMDVWGQGTTVTVSS | 476 |
| vhCDR1 | GGTFSSSA | 477 |
| vhCDR2 | IIPIYGIT | 478 |
| vhCDR3 | ARDDTARRVRGVPYYYYAMDV | 479 |
| Full length HC | EVQLVQSGAEVKKPGSSVKVSCKTSGGTFSSSAISWVRQAPGQGFEWMGGIIPIYGITDYAQKFQGRVTITTDESTSTA YMELSSLTSEDTAVYYCARDDTARRVRGVPYYYYAMDVWGQGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 480 |
| Variable light (vl) domain | EIVLTQSPGTLSLSPGERATLSCRASQSVSSYLAWYQQKPGQAPRLLIYDASNRATGIPARFSGSGSGTDFTLTISSLQSE DFAVYYCQQYDDWPQTFGQGTRLEIKRTVAAPS | 481 |
| vlCDR1 | QSVSSY | 482 |
| vlCDR2 | DAS | 483 |
| vlCDR3 | QQYDDWPQT | 484 |
| Full length light chain | EIVLTQSPGTLSLSPGERATLSCRASQSVSSYLAWYQQKPGQAPRLLIYDASNRATGIPARFSGSGSGTDFTLTISSLQSE DFAVYYCQQYDDWPQTFGQGTRLEIKRTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRGEC | 485 |

Figure 39E
CPA.7.020

| What | sequence | SEQ ID NO: |
|---|---|---|
| Variable heavy (vh) domain | QMQLVQSGAEVKKPGSSVKVSCKASGGTFSSSAISWVRQAPGQGFEWMGGIIPIYGITDYAQKFQGRVTITTDES TSTAYMELSSLTSEDTAVYYCARDDTARRVRGVPYYYYAMDVWGQGTTVTVSS | 486 |
| vhCDR1 | GGTFSSSA | 487 |
| vhCDR2 | IIPIYGIT | 488 |
| vhCDR3 | ARDDTARRVRGVPYYYYAMDV | 489 |
| Full length HC | QMQLVQSGAEVKKPGSSVKVSCKASGGTFSSSAISWVRQAPGQGFEWMGGIIPIYGITDYAQKFQGRVTITTDES TSTAYMELSSLTSEDTAVYYCARDDTARRVRGVPYYYYAMDVWGQGTTVTVSSASTKGPSVFPLAPSSKSTSGG TAALGCLVKDYFPEPVTVSWNSGALTSGVHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFSCSVMHEALHNHYTQKSL SLSPGK | 490 |
| Variable light (vl) domain | EIVMTQSPATLSLSTGERATLFCRTSQNVYGEVAWYQQKPGQAPRLLIYDTFERAAGIPAKFSGSGSGTDFTLTISR VEPEDFAVYYCQQRRDWPITFGQGTRLEIKRTVAAPS | 491 |
| vlCDR1 | QNVYGE | 492 |
| vlCDR2 | DTF | 493 |
| vlCDR3 | QQRRDWPIT | 494 |
| Full length light chain | EIVMTQSPATLSLSTGERATLFCRTSQNVYGEVAWYQQKPGQAPRLLIYDTFERAAGIPAKFSGSGSGTDFTLTISR VEPEDFAVYYCQQRRDWPITFGQGTRLEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 495 |

Figure 39F
CPA.7.038

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 496 |
| vhCDR1 | GGTFSSSA | 497 |
| vhCDR2 | IIPIYGIT | 498 |
| vhCDR3 | ARDDTARRVRGVPYYYYAMDV | 499 |
| Full length HC | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 500 |
| Variable light (vl) domain | DIQMTQSPSSLSASVGDRVTITCQASRDISDSLSWYQQKPGKAPKLLIFDASNLKTGVSSRFSGSGSGTDFTFTISSLQPE DIATYYCHQYDNLPLTFGGGTKVEIKRTVAAPS | 501 |
| vlCDR1 | RDISDS | 502 |
| vlCDR2 | DAS | 503 |
| vlCDR3 | HQYDNLPLT | 504 |
| Full length light chain | DIQMTQSPSSLSASVGDRVTITCQASRDISDSLSWYQQKPGKAPKLLIFDASNLKTGVSSRFSGSGSGTDFTFTISSLQPE DIATYYCHQYDNLPLTFGGGTKVEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 505 |

Figure 39G
CPA.7.044

| What | sequence | SEQ ID NO: |
|---|---|---|
| Variable heavy (vh) domain | QMQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 506 |
| vhCDR1 | GGTFSSSA | 507 |
| vhCDR2 | IIPIYGIT | 508 |
| vhCDR3 | ARDDTARRVRGVPYYYYAMDV | 509 |
| Full length HC | QMQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 510 |
| Variable light (vl) domain | EIVMTQSPATLSLSPGERATLSCRASESVTTFLAWYQQKPGQAPRLLITDASNRATGIPGRFSGSGSGTDFTLTISSLEPE DFAVYYCHQHTNWPLTFGGGTKLEIKRTVAAPS | 511 |
| vlCDR1 | ESVTTF | 512 |
| vlCDR2 | DAS | 513 |
| vlCDR3 | HQHTNWPLT | 514 |
| Full length light chain | EIVMTQSPATLSLSPGERATLSCRASESVTTFLAWYQQKPGQAPRLLITDASNRATGIPGRFSGSGSGTDFTLTISSLEPE DFAVYYCHQHTNWPLTFGGGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 515 |

Figure 39H
CPA.7.045

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVGYCSGGSCYISYYYGMDVWGQGTTVTVSS | 516 |
| vhCDR1 | GYTLTELS | 517 |
| vhCDR2 | FDPEDGET | 518 |
| vhCDR3 | ATEVGYCSGGSCYISYYYGMDV | 519 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVGYCSGGSCYISYYYGMDVWGQGTTVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKKVEPKSCDK THTCPPCPAPELLGGPSVFLFPPKPKDTLMISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVYTLPPSREEMTKNQVSLTCLVKGFYPSDIAVE WESNGQPENNYKTTPPVLDSDGSFFLYSKLTVDKSRWQQGNVFSCSVMHEALHNHYTQKSLSLSPGK | 520 |
| Variable light (vl) domain | DVVMTQSPLSLPVTPGEPASISCRSSQSLLYRNGHNFLDWYVQKPGQSPQLLIYLGSNRASGVPDRFSGSGSGTDFTLKI SRVEAEDVGVYYCMQALQTPPTFGQGTKLEIKRTVAAPS | 521 |
| vlCDR1 | QSLLYRNGHNF | 522 |
| vlCDR2 | LGS | 523 |
| vlCDR3 | MQALQTPPT | 524 |
| Full length light chain | DVVMTQSPLSLPVTPGEPASISCRSSQSLLYRNGHNFLDWYVQKPGQSPQLLIYLGSNRASGVPDRFSGSGSGTDFTLKI SRVEAEDVGVYYCMQALQTPPTFGQGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 525 |

Figure 40A

CDRs

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.001 | GGTFSSYA | 526 | IIPIFGTA | 527 | AREVSSPYGMDV | 528 | TGAVTSGHY | 529 | DTG | 530 | LLSYGASWV | 531 |
| CPA.7.002 | GGTFSSSA | 532 | IIPIYGIT | 533 | ARDDTARRVRGVPYYYYAMDV | 534 | QGIGNY | 535 | SAS | 536 | QQLKDYPIT | 537 |
| CPA.7.003 | GFSLSHFS | 538 | FDPEEGGT | 539 | ATGIWYSSGWPVDY | 540 | QSLLDSSGYNY | 541 | LGS | 542 | MQALQTPIT | 543 |
| CPA.7.004 | GYTLTELS | 544 | FDPEDGET | 545 | ATVSRVRGVINYYYYMDV | 546 | QSLLYRNGNNY | 547 | LGS | 548 | MQALQTPPT | 549 |
| CPA.7.005 | GGTFSSSA | 550 | IIPIYGIT | 551 | ARDDTARRVRGVPYYYYAMDV | 552 | QSVDSS | 553 | DAS | 554 | QQYKDWPFT | 555 |
| CPA.7.006 | GGTFGTYA | 556 | ITPISATI | 557 | ARGFEYSDGLLDD | 558 | QSLFYSDDGNTY | 559 | RLS | 560 | MQHMEFPLT | 561 |
| CPA.7.007 | GGSISSSSYY | 562 | IYYSGST | 563 | ARGAMELRLGDWFDP | 564 | SSNIGAGYD | 565 | GNN | 566 | QSYDSSLSIYVV | 567 |
| CPA.7.008 | SGSISTNW | 568 | IYHSGST | 569 | ARVGPAAIYY | 570 | SNNVGYEG | 571 | RNN | 572 | SAWDSSLNAVV | 573 |
| CPA.7.009 | GYTLTELS | 574 | FDPEDGET | 575 | ATAKPGIAVAGQNYYYYYMDV | 576 | QSLLYRNGNNY | 577 | LGS | 578 | MQALQTPPT | 579 |
| CPA.7.010 | GFTFSSYA | 580 | ISYDGSNK | 581 | ASSPIGYSYGYWGGMDV | 582 | SGIDVRTNK | 583 | FQSDSDK | 584 | LIWHTSGWV | 585 |
| CPA.7.011 | GYTLTELS | 586 | FDPEDGET | 587 | ATGPAAAGVGYYYYMDV | 588 | QSLLYRNGYNY | 589 | LGS | 590 | MQALQTPPT | 591 |
| CPA.7.012 | GFTFSSYA | 592 | ISYDGSNK | 593 | ARDVMVYCSSTSCYFYGMDV | 594 | QDIRDY | 595 | DAS | 596 | QQFENLPIT | 597 |
| CPA.7.013 | GYTLTELS | 598 | FDPEDGET | 599 | ATGGYSSGFNYYYYYMDV | 600 | QSLLYRNGNNY | 601 | LGS | 602 | MQALQTPPT | 603 |

Figure 40B

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.014 | GYTLTELS | 604 | FDPEDGET | 605 | ATGVITYYYGMDV | 606 | QSLLYSNGNNF | 607 | LGS | 608 | MQALQTPPT | 609 |
| CPA.7.015 | GFTFSSYG | 610 | IRYDGSNK | 611 | ARDLFDFWWDGMDV | 612 | QSVSSMY | 613 | GAS | 614 | QQYSSPMYT | 615 |
| CPA.7.016 | GGTFSSSA | 616 | IIPIYGIT | 617 | ARDDTARRVRGVPYYYYAMDV | 618 | QSVSSY | 619 | DAS | 620 | QQYDDWPQT | 621 |
| CPA.7.017 | GGTFNNYG | 622 | IIPLFGTT | 623 | ARDRMAADGMAVFDY | 624 | SSNIGRHF | 625 | KND | 626 | SSWDAAINGVV | 627 |
| CPA.7.018 | GYTLTELS | 628 | FDPEDGET | 629 | ATEVPMVRGARRYYYYMDV | 630 | QTLLYINENNY | 631 | LGS | 632 | MQGLQTPPT | 633 |
| CPA.7.019 | GGSISNSNYY | 634 | IYYSGST | 635 | ARGAWELSLGDWFDP | 636 | SSNIGAGYD | 637 | GNN | 638 | QSYDSSLSYVYV | 639 |
| CPA.7.020 | GGTFSSSA | 640 | IIPIYGIT | 641 | ARDDTARRVRGVPYYYYAMDV | 642 | QNVYGE | 643 | DTF | 644 | QQRRDWPIT | 645 |
| CPA.7.021 | GFTFGTSS | 646 | ISFDGTEI | 647 | AKGSGNYFYSGMDV | 648 | QSISGW | 649 | ETS | 650 | QQYSYPLT | 651 |
| CPA.7.022 | GYTLTELS | 652 | FDPEDGET | 653 | ATGVPAAIGVYYYYMDV | 654 | QSLLYSNGYNY | 655 | LGS | 656 | MQALQSPVT | 657 |
| CPA.7.023 | GYTLTELS | 658 | FDPEDGET | 659 | ATDSRDGPAARGGYYYYMDV | 660 | QSLLYNGYNY | 661 | LGS | 662 | MQALQTPPT | 663 |
| CPA.7.024 | GGTFSSYA | 664 | IIPIFGTA | 665 | ARDAYYYDSSGYYNPDAFDI | 666 | QSLLHSNGYNY | 667 | LGS | 668 | MQGLQTPRT | 669 |
| CPA.7.025 | GFSLTSGGMS | 670 | IDWNDDK | 671 | ARIRGMTWGFDS | 672 | QSVSSSY | 673 | GAS | 674 | QQYGTTPFA | 675 |
| CPA.7.026 | GYTFTAYY | 676 | INPNSGGT | 677 | ARDGAFYYGSENYYNAGWFDP | 678 | QSLLSGNGYNY | 679 | LGS | 680 | MQALKSPLT | 681 |
| CPA.7.027 | GYTFTNYY | 682 | INPSGGIT | 683 | ARAGLGYNWNYAPSGMDV | 684 | SSDVGGYNY | 685 | EVS | 686 | SSYAGSNNLV | 687 |
| CPA.7.028 | GGSISSSSYY | 688 | IYYSGST | 689 | ARGAWELRLGDWFDP | 690 | SSNIGAGYD | 691 | GYS | 692 | QSYDSSLSVYVV | 693 |

Figure 40C

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.029 | GFTFDDYA | 694 | ISWNSGSI | 695 | AKDVNRILVAGMVDY | 696 | QSLLHSNGYNY | 697 | LGS | 698 | MQGLQTPIT | 699 |
| CPA.7.030 | RFTFEDYA | 700 | ISWKSGGI | 701 | VKDPTLVATDRAFNI | 702 | QSLLHSNGYNY | 703 | LGS | 704 | MQYLQTPDT | 705 |
| CPA.7.031 | GGTFSSSA | 706 | IIPIYGIT | 707 | ARDDTARRVRGVPYYYYAMDV | 708 | QSLLDSDGNIH | 709 | TLS | 710 | MQRKEFPLT | 711 |
| CPA.7.032 | GFTFSSYG | 712 | ISYDGSNK | 713 | AKEDRLRFLEWLFYGMDV | 714 | HDIYTY | 715 | DAS | 716 | QQYDNHPPEVT | 717 |
| CPA.7.033 | GGTFSSSA | 718 | IIPIYGIT | 719 | ARDDTARRVRGVPYYYYAMDV | 720 | QDIDDD | 721 | EAS | 722 | LQHDNLPLT | 723 |
| CPA.7.034 | GYTLTELS | 724 | FDPEDGET | 725 | ATEDPGPVAGPYYYYGMDV | 726 | QSLLYINGYHY | 727 | LGS | 728 | MQALQTPPT | 729 |
| CPA.7.035 | GYMFTNYP | 730 | INAGTGNT | 731 | AREGMFYYGLESYYKGGWFDP | 732 | QSLLHRNGYNY | 733 | LAS | 734 | MQALQTPLT | 735 |
| CPA.7.036 | GGTFSSSA | 736 | IIPIYGIT | 737 | ARDDTARRVRGVPYYYYYAMDV | 738 | QSLLDSDDGNTY | 739 | TLS | 740 | MQRLQFPLT | 741 |
| CPA.7.037 | TYTFTTYY | 742 | IYPSGGNT | 743 | VRDQNYYYSAMDV | 744 | QDIRNY | 745 | DAS | 746 | QQFENLPIT | 747 |
| CPA.7.038 | GGTFSSSA | 748 | IIPIYGIT | 749 | ARDDTARRVRGVPYYYYAMDV | 750 | RDISDS | 751 | DAS | 752 | HQYDNLPLT | 753 |
| CPA.7.039 | GFNFRGYA | 754 | ISGSGGTT | 755 | AQSYAQIGYGGHIDH | 756 | SGIDVATYM | 757 | YKSDSDK | 758 | LIWHGSHYV | 759 |
| CPA.7.040 | GYTLTELS | 760 | FDPEDGET | 761 | ATGVPAAIGVYYYYYMDV | 762 | QSLLYRNGYNY | 763 | WGS | 764 | MQAVQNPPT | 765 |
| CPA.7.041 | GGTFSSSA | 766 | IIPIYGIT | 767 | ARDDTARRVRGVPYYYYAMDV | 768 | QNIDSS | 769 | YAS | 770 | HQSSSLPLT | 771 |
| CPA.7.042 | GGTFSSSA | 772 | IIPIYGIT | 773 | ARDDTARRVRGVPYYYYAMDV | 774 | QSVYNNY | 775 | DAS | 776 | QQYNSWPPYT | 777 |
| CPA.7.043 | GGTFSSYA | 778 | IIPIFGTA | 779 | ARDAYYYDSSGYYNPDAFDI | 780 | QSLLYSNGYNY | 781 | LGS | 782 | MQARQIPYT | 783 |

Figure 40D

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.044 | GGTFSSSA | 784 | IIPIYGIT | 785 | ARDDTARRVRGVPYYYYAMDV | 786 | ESVTTF | 787 | DAS | 788 | HQHTNWPLT | 789 |
| CPA.7.045 | GYTLTELS | 790 | FDPEDGET | 791 | ATEVGYCSGGSCYISYYYGMDV | 792 | QSLLYRNGHNF | 793 | LGS | 794 | MQALQTPPT | 795 |
| CPA.7.046 | GGTFSSSA | 796 | IIPIYGIT | 797 | ARDDTARRVRGVPYYYYAMDV | 798 | QTMNNY | 799 | DAS | 800 | QQYGDWLPLT | 801 |
| CPA.7.047 | GYTLTELS | 802 | FDPEDGET | 803 | ATAFPEATSYYYYMDV | 804 | QSLLYRNGYNY | 805 | WGS | 806 | MQAVQNPPT | 807 |
| CPA.7.049 | GGTFSSSA | 808 | IIPIYGIT | 809 | ARDDTARRVRGVPYYYYAMDV | 810 | RSLLDSDDGNTH | 811 | SLS | 812 | MQRKEFPLT | 813 |
| CPA.7.050 | GGTFSSYA | 814 | IIPIFGTA | 815 | ARGPWYYDSSGYSSYAYYMDV | 816 | QSLLHSDGYNY | 817 | LGS | 818 | MQALHTPGVT | 819 |

Figure 41A

CHA.7.502

| What | sequence | SEQ ID NO: |
|---|---|---|
| Variable heavy (vh) domain | DVQLVESGGDLVQPGGSRKLSCTASGFTFSNFGMHWVRQAPEKGLEWVAYISSGSSTIYYADTVKGRFTISRDNPENTLFLQMTSLRSEDTAMYYCTRLDYYTNSYSMDHWGQGTSVTVSS | 820 |
| vhCDR1 | GFTFSNFG | 821 |
| vhCDR2 | ISSGSSTI | 822 |
| vhCDR3 | TRLDYYTNSYSMDH | 823 |
| Variable light (vl) domain | QIVLTQSPALMSASPGEKVTLTCSASSSLPYIYWYQQKPGSSPKPWIYLTSNLASGVPARFSGSRSGTSYSLTISSVEAEDAATYYCQQWSSNPFTFGSGTKLEIK | 824 |
| vlCDR1 | SSLPY | 825 |
| vlCDR2 | LTS | 826 |
| vlCDR3 | QQWSSNPFT | 827 |

Figure 41B

CHA.7.503

| What | sequence | SEQ ID NO: |
|---|---|---|
| Variable heavy (vh) domain | QVQLQQSGAELAKPGASVKMSCKASGYTFTSNWMHWVKQRPGQGLEWIGYINPSNGYTECNQKFRDKATLSADKSSSTAYMQLNSLTSADSAVYYCALMISAWLPYWGQGTLVTVSA | 828 |
| vhCDR1 | GYTFTSNW | 829 |
| vhCDR2 | INPSNGYT | 830 |
| vhCDR3 | ALMISAWLPY | 831 |
| Variable light (vl) domain | DIVLTQSPASLAISLGQRATISCRASQSVSASSYSYVHWYQQKPGQPPKLLIKYASSLESGVPARFSGSGSGTDFTLNIHPVEEEDTATYYCLHTWEIPYTFGGGTKLEIK | 832 |
| vlCDR1 | QSVSASSYSY | 833 |
| vlCDR2 | YAS | 834 |
| vlCDR3 | LHTWEIPYT | 835 |

Figure 41C

CHA.7.506

| What | sequence | SEQ ID NO: |
|---|---|---|
| Variable heavy (vh) domain | QVQLQQSGAELTRPGASVNLSCKASGYTFTSYWMQWVKQRPGQGLEWIGAIYPGDGDTRFNQKFKGKATLTADESSSTAYMQLSSLASEDSAVYYCATYYRYDDYWGQGTTLTVSS | 836 |
| vhCDR1 | GYTFTSYW | 837 |
| vhCDR2 | IYPGDGDT | 838 |
| vhCDR3 | ATYYRYDDY | 839 |
| Variable light (vl) domain | QIVLTQSPAIMSASPGEKVTMTCSASSSVSYMHWYQQKSGTSPKRWIYDTSKLASGVPTRFSGSGSGTSYSLTISSMEAEDAATYYCQQWSSNPYTFGGGTKLEIK | 840 |
| vlCDR1 | SSVSY | 841 |
| vlCDR2 | DTS | 842 |
| vlCDR3 | QQWSSNPYT | 843 |

Figure 41D

CHA.7.508

| What | sequence | SEQ ID NO: |
|---|---|---|
| Variable heavy (vh) domain | EVQLQQSGPDLVKPGASMKISCKAS<u>GYTFIDYN</u>IHWVKQSQGKSLDWIGY<u>IYPYNGGT</u>GYNQKFKNKATLTVDSSSSTAYMEVRSLTFEDSAVYFC<u>AREADYYGNRGQFDY</u>WGQGTLVTVSA | 844 |
| vhCDR1 | GYTFIDYN | 845 |
| vhCDR2 | IYPYNGGT | 846 |
| vhCDR3 | AREADYYGNRGQFDY | 847 |
| Variable light (vl) domain | DIQMTQSPASLSVSVGETVTITCRAS<u>ENIFSN</u>LAWYQQKQGKSPQLLVY<u>GEA</u>NLADGVPSRFSGSGSGTQYSLKINSLQSEDFGNYYC<u>QHFWGTPYT</u>FGGGTTLEIK | 848 |
| vlCDR1 | ENIFSN | 849 |
| vlCDR2 | GEA | 850 |
| vlCDR3 | QHFWGTPYT | 851 |

Figure 41E

CHA.7.510

| What | sequence | SEQ ID NO: |
|---|---|---|
| Variable heavy (vh) domain | QVTLKESGPGILQPSQTLSLTCSFSGFSLNTSGTGVGWIRQPSGKGLEWLTHIWWNDNKFYNTFLKSRLTISKETSNNQVFLKIASVDTADAATYYCARMAYGNLWFVNWGQGTLVAVST | 852 |
| vhCDR1 | GFSLNTSGTG | 853 |
| vhCDR2 | IWWNDNK | 854 |
| vhCDR3 | ARMAYGNLWFVN | 855 |
| Variable light (vl) domain | DIVLTQSPASLAVSLGQRASISCRASRSVTISGYSYMYWYQQKPGQPPRLLFYLASNLASGVPARFSGSGSGTDFTLNIHPVEEEDAAIYYCQHSRELPYTFGGGTKLEIK | 856 |
| vlCDR1 | RSVTISGYSY | 857 |
| vlCDR2 | LAS | 858 |
| vlCDR3 | QHSRELPYT | 859 |

Figure 41F

CHA.7.512

| What | sequence | SEQ ID NO: |
|---|---|---|
| Variable heavy (vh) domain | QIQLVQSGPELKKPRETVKISCKAS<u>GYTFTDYS</u>MHWVKQAPGKGLKWMGW<u>INTET GEP</u>TYADDFKGRFAFSLEASASSAYLQINILKDEDTATYFC<u>ARSRGGYYEDYYALDY</u>W GQGTSVTVSS | 860 |
| vhCDR1 | GYTFTDYS | 861 |
| vhCDR2 | INTETGEP | 862 |
| vhCDR3 | ARSRGGYYEDYYALDY | 863 |
| Variable light (vl) domain | DIQMTQSPASLSASVGESVTITCRAS<u>GNIHYY</u>LAWYQQKQGKSPQLLVY<u>NAK</u>NLAD GVPSRFSGSGSGTQFSLKINSLQPEDFGSYYC<u>QHFWISPPT</u>FGGGTKLEIK | 864 |
| vlCDR1 | GNIHYY | 865 |
| vlCDR2 | NAK | 866 |
| vlCDR3 | QHFWISPPT | 867 |

Figure 41G

CHA.7.514

| What | sequence | SEQ ID NO: |
|---|---|---|
| Variable heavy (vh) domain | EVQLRQSGADLVKPGASVKLSCTASGFNIKDTYIDWVKQRPEQGLDWIGRIDPANGNTKYDPKFQGKATIITDTSSNTAYLQLSNLTSEDTAVYYCARYGSYPYFDYWGRGTTLAVSS | 868 |
| vhCDR1 | GFNIKDTY | 869 |
| vhCDR2 | IDPANGNT | 870 |
| vhCDR3 | ARYGSYPYFDY | 871 |
| Variable light (vl) domain | SIVMTQTPKFLLISAGDRVTITCKASQSVRNDVAWYQQKPGQSPKLLMYYASNRYTGVPDRFTGSGYGTDFTFTISTVQAEDLAVYFCQQDYSSPPTFGGGTKLEIK | 872 |
| vlCDR1 | QSVRND | 873 |
| vlCDR2 | YAS | 874 |
| vlCDR3 | QQDYSSPPT | 875 |

Figure 41.H

CHA.7.516

| What | sequence | SEQ ID NO: |
|---|---|---|
| Variable heavy (vh) domain | QVQLQQSGPELVRPGVSVKISCKVSGYTFTDYVMHWVKQSHAKSLEWIGIISPYSGNTNYNQNFKGKATMTVDKSSSTAYMALARLTSEDSAIYYCAREGDLPMFAYWGQGTLVTVSA | 876 |
| vhCDR1 | GYTFTDYV | 877 |
| vhCDR2 | ISPYSGNT | 878 |
| vhCDR3 | AREGDLPMFAY | 879 |
| Variable light (vl) domain | QIVLTQSPTIMSASPGEKVTMTCSASSSVSYIYWYQQNPGSSPRLLIYDTSILASGVPFRFSGSGSGTSYSLTISRMEAEDAATYYCQQWTSYPLTFGSGTKLELK | 880 |
| vlCDR1 | SSVSY | 881 |
| vlCDR2 | DTS | 882 |
| vlCDR3 | QQWTSYPLT | 883 |

Figure 411

CHA.7.518

| What | sequence | SEQ ID NO: |
|---|---|---|
| Variable heavy (vh) domain | EVQLQQSGPELVKPGASVKISCKASGYTFTDYNINWVKQSHGKSLEWIGYIYPYIGGS GYNQKFKSKATLSADNPSSTAYMELRSLTSEDSAVYYCAREDKTARNAMDYWGQG TPVTVSS | 884 |
| vhCDR1 | GYTFTDYN | 885 |
| vhCDR2 | IYPYIGGS | 886 |
| vhCDR3 | AREDKTARNAMDY | 887 |
| Variable light (vl) domain | DIQMTQSPASLSVSVGETVTIICRVSENIYSNLAWYQQKQGKSPQLLVYEATNLAEG VPSRFSGSGSGTQYSLKINSLQSEDFGSYYCQHFWGTPYTFGGGTKLEIK | 888 |
| vlCDR1 | ENIYSN | 889 |
| vlCDR2 | EAT | 890 |
| vlCDR3 | QHFWGTPYT | 891 |

Figure 41J

CHA.7.520_1

| What | sequence | SEQ ID NO: |
|---|---|---|
| Variable heavy (vh) domain | DVQLQESGPGLVKPSQSLSLTCTVTGYSITSDYAWNWIRQFPGNKLEWMGYISYSGSTSYNPSLKSRISITRDTSKNQFFLQLNSVTTEDTATYYCARHYRYPPYAMDYWGQGTSVTVSS | 892 |
| vhCDR1 | GYSITSDYA | 893 |
| vhCDR2 | ISYSGST | 894 |
| vhCDR3 | ARHYRYPPYAMDY | 895 |
| Variable light (vl) domain | DIVMTQSPSSLAMSVGQKVTMSCKSSQSLLNSSNQKNYLAWYQQKPGQSPKLLVYFASTRESGVPDRFIGSGSGTDFTLTITSVQAEDLADYFCQQHYSTPFTFGSGTKLEIK | 896 |
| vlCDR1 | QSLLNSSNQKNY | 897 |
| vlCDR2 | FAS | 898 |
| vlCDR3 | QQHYSTPFT | 899 |

Figure 41K

CHA.7.520_2

| What | sequence | SEQ ID NO: |
|---|---|---|
| Variable heavy (vh) domain | QVQLKQSGPGLVQPSQSLSITCTVSGFSLTSFGVHWVRQSPGKGLEWLGVIWSGGT TVYDAAFISRLSISKDNSKSQVFFKMNSLQTNDTAIYYCARKRGNFYVMDYWGQGT SVTVSS | 900 |
| vhCDR1 | GFSLTSFG | 901 |
| vhCDR2 | IWSGGTT | 902 |
| vhCDR3 | ARKRGNFYVMDY | 903 |
| Variable light (vl) domain | DIVMTQSPSSLAMSVGQKVTMSCKSSQSLLNSSNQKNYLAWYQQKPGQSPKLLVY FASTRESGVPDRFIGSGSGTDFTLTITSVQAEDLADYFCQQHYSTPFTFGSGTKLEIK | 904 |
| vlCDR1 | QSLLNSSNQKNY | 905 |
| vlCDR2 | FAS | 906 |
| vlCDR3 | QQHYSTPFT | 907 |

Figure 41L

CHA.7.522

| What | sequence | SEQ ID NO: |
|---|---|---|
| Variable heavy (vh) domain | QVQLQQPGSELVRPGTSVKLSCKASGYTFTSYWVHWVRQRHGQGLEWIGNVYPGSGSTNYDEKFKSKGTLTVDTSSSTAYMHLSSLTSEDSAVYYCTRGVLRFPLDYWGQGTTLTVSS | 908 |
| vhCDR1 | GYTFTSYW | 909 |
| vhCDR2 | VYPGSGST | 910 |
| vhCDR3 | TRGVLRFPLDY | 911 |
| Variable light (vl) domain | DIVMTQAAPSVPVTPGESVSISCRSSKSLLHSNGNTYLYWFLQRPGQSPHLLIYRMSNLASGVPDRFSGSGSGTAFTLRISRVEAEDVGVYYCMQHLEYPLTFGAGTKLELK | 912 |
| vlCDR1 | KSLLHSNGNTY | 913 |
| vlCDR2 | RMS | 914 |
| vlCDR3 | MQHLEYPLT | 915 |

Figure 41M

CHA.7.524

| What | sequence | SEQ ID NO: |
|---|---|---|
| Variable heavy (vh) domain | QVQLQQSGPEVVRPGVSVKISCKGSGYKFPDYVMHWVKQSHAKSLEWIGISIYSG NTNYNQKFKGKATMTVDKSSSTAYMELARLTSEDSAIYYCAREGDLPMFAYWGQG TLVTVSA | 916 |
| vhCDR1 | GYKFPDYV | 917 |
| vhCDR2 | ISIYSGNT | 918 |
| vhCDR3 | AREGDLPMFAY | 919 |
| Variable light (vl) domain | QIVLTQSPAIMSASPGEKVTMTCNASSSVSYMYWYQQKPISSPRLLIYDTSNLASGV PVRFSGSGSGTSYSLTIGRMEAEDAATYYCQQWSSYPLTFGAGTKVEVK | 920 |
| vlCDR1 | SSVSY | 921 |
| vlCDR2 | DTS | 922 |
| vlCDR3 | QQWSSYPLT | 923 |

Figure 41N

CHA.7.526

| What | sequence | SEQ ID NO: |
|---|---|---|
| Variable heavy (vh) domain | QVQLKESGPGLVAPSQSLSITCTVSGFSLTAYNINWVRQPPGKGLEWLGMIWGDGNTDYNSPLKSRLTISKDNSKSQVFLKMDSLQTDDTARYYCARDLKVRRDSPYTMDYWGQGTSVTVSS | 924 |
| vhCDR1 | GFSLTAYN | 925 |
| vhCDR2 | IWGDGNT | 926 |
| vhCDR3 | ARDLKVRRDSPYTMDY | 927 |
| Variable light (vl) domain | NIMMTQSPSSLAVSAGEKVTMSCKSSQSVLYSSNQKNYLAWYQQKPGQSPKLLIYWASNRESGVPDRFTGSGSGTDFTLTISSVQAEDLAVYYCHQYLSSYTFGGGTKLEIK | 928 |
| vlCDR1 | QSVLYSSNQKNY | 929 |
| vlCDR2 | WAS | 930 |
| vlCDR3 | HQYLSSYT | 931 |

Figure 410

CHA.7.527

| What | sequence | SEQ ID NO: |
|---|---|---|
| Variable heavy (vh) domain | DVQLQESGPGLVKPSQSLSLTCTVTGYSLTSDYAWNWIRQFPGNKLEWMGYITYSGGTTYNPSLKSRISITRDTSKNQFFLQLTSVTTEDTATYYCARRGSGTTVVGDWYFDVWGAGTTVTVSS | 932 |
| vhCDR1 | GYSLTSDYA | 933 |
| vhCDR2 | ITYSGGT | 934 |
| vhCDR3 | ARRGSGTTVVGDWYFDV | 935 |
| Variable light (vl) domain | DIVMSQSPSSLAVSVGEKVTMSCKSSQSLLYSFNQKYYLAWYQQKPGQSPKLLIYWASTRESGVPDRFTGSGSGTDFTPTISSVTAEDLAVYYCQQFYTYPYTFGGGTKLEMK | 936 |
| vlCDR1 | QSLLYSFNQKYY | 937 |
| vlCDR2 | WAS | 938 |
| vlCDR3 | QQFYTYPYT | 939 |

Figure 41P

CHA.7.528

| What | sequence | SEQ ID NO: |
|---|---|---|
| Variable heavy (vh) domain | EVQVQQSGPELVKPGASVKISCKASGYTFTKSNMHWVKQSHGKSLEWIGYIYPYNGGTGYNQNFKSKATLTVDISSSTAYMELRSLTLEDSAVYLCAREADYYGNRGQFDYWGQGTLVTVSA | 940 |
| vhCDR1 | GYTFTKSN | 941 |
| vhCDR2 | IYPYNGGT | 942 |
| vhCDR3 | AREADYYGNRGQFDY | 943 |
| Variable light (vl) domain | DIQMTQSPASLSVSVGETVTITCRASDNIFSNLAWYHQKQGKSPHLLVYGATNLADGVPSRFSGSGSGTQYSLKINSLQSEDFGDYYCQHFWGTPYTFGGGTKLEIK | 944 |
| vlCDR1 | DNIFSN | 945 |
| vlCDR2 | GAT | 946 |
| vlCDR3 | QHFWGTPYT | 947 |

Figure 41Q

CHA.7.530

| What | sequence | SEQ ID NO: |
|---|---|---|
| Variable heavy (vh) domain | QVQLQQSGAELMRPGTSVKVSCKASGYAFTNHLIEWIKQRPGQGLEWIGVINPGSDSTDYNEKFKDKATLTADKSSSTAYMQLSSLTSDDSAVYFCARSLYYNSWFVYWGQGTLVTVSA | 948 |
| vhCDR1 | GYAFTNHL | 949 |
| vhCDR2 | INPGSDST | 950 |
| vhCDR3 | ARSLYYNSWFVY | 951 |
| Variable light (vl) domain | DIQMTQSPASLSASVGETVTITCRASENIYSYLAWYQQKRGKSPQLLVYNAKTLVEGVPSRFSGSGSGTQFSLKINSLQPEDFGSYYCQHHYGTPYTFGGGTKLEIK | 952 |
| vlCDR1 | ENIYSY | 953 |
| vlCDR2 | NAK | 954 |
| vlCDR3 | QHHYGTPYT | 955 |

Figure 41R

CHA.7.534

| What | sequence | SEQ ID NO: |
|---|---|---|
| Variable heavy (vh) domain | EVQLQQSGAELVKPGASVRLSCTASGFSIRDTYIHWVKQRPEQGLDWIGKIDPANGKSEYDPKFQGRATMTTDTSSNTAYLQLSSLTSEDTAVYYCTRYGYYPYFDVWGAGTTVTVFS | 956 |
| vhCDR1 | GFSIRDTY | 957 |
| vhCDR2 | IDPANGKS | 958 |
| vhCDR3 | TRYGYYPYFDV | 959 |
| Variable light (vl) domain | SIVMTQTPKFLLVSAGDRVAITCKASQSVRHDVVWYQQKPGQSPKLLIYYASSRYTGVPDRFTGSGYGTDFTFTISTVQAEDLALYFCLQDFSSPWTFGGGTKLEIK | 960 |
| vlCDR1 | QSVRHD | 961 |
| vlCDR2 | YAS | 962 |
| vlCDR3 | LQDFSSPWT | 963 |

Figure 41S

CHA.7.535

| What | sequence | SEQ ID NO: |
|---|---|---|
| Variable heavy (vh) domain | EVQLQQSGPELVKPGASVKISCKTSGYTFTKNTMHWVRQSHGKSLEWIGGINPNSGGASFNQKFMGKATLTVDKSSSTAYMELRSLTSEDSAVYYCARDGYDGDWFFDVWGAGTTVTVSS | 964 |
| vhCDR1 | GYTFTKNT | 965 |
| vhCDR2 | INPNSGGA | 966 |
| vhCDR3 | ARDGYDGDWFFDV | 967 |
| Variable light (vl) domain | DIQMNQSPFSLSASLGDTVTITCHASQNIYVWLSWYQQKPGNIPKLLIYKASDLHTGVPSRFSGSGSGTDFTLNISSLQPEDIATYYCQQGQSYPRTFGGGTKLEIK | 968 |
| vlCDR1 | QNIYVW | 969 |
| vlCDR2 | KAS | 970 |
| vlCDR3 | QQGQSYPRT | 971 |

Figure 41T

CHA.7.537

| What | sequence | SEQ ID NO: |
|---|---|---|
| Variable heavy (vh) domain | QVQLKESGPGLVAPSQSLSITCTVSGFSLIGHGVNWIRQPPGKGLEWLGVIWGDGNTDYNSALKSRLSISKDNSKSQVFLKMNSLQTDDTARYFCAVNSAMDYWGQGTAVTVSS | 972 |
| vhCDR1 | GFSLIGHG | 973 |
| vhCDR2 | IWGDGNT | 974 |
| vhCDR3 | AVNSAMDY | 975 |
| Variable light (vl) domain | NIVMTQSPKSMSMSVGERVTLNCTASENVASFVSWYQQKPEQSPKLLIYGTSNRYTGVPDRFTGSGSATDFTLTISSVQAEDLGDYHCGQSYNYPFTFGSGTKLEIE | 976 |
| vlCDR1 | ENVASF | 977 |
| vlCDR2 | GTS | 978 |
| vlCDR3 | GQSYNYPFT | 979 |

Figure 41U

CHA.7.538_1

| What | sequence | SEQ ID NO: |
|---|---|---|
| Variable heavy (vh) domain | QVQLQQSGAELVRPGASVKVSCKTSGYAFTNYLIEWVKQRPGQGLEWIGVINPGSGGIYYNDKFKVKTTLTADKSSSTAYMQLSSLTSDDSAVYFCARSETHDTWFAYWGQGTLVTVSA | 980 |
| vhCDR1 | GYAFTNYL | 981 |
| vhCDR2 | INPGSGGI | 982 |
| vhCDR3 | ARSETHDTWFAY | 983 |
| Variable light (vl) domain | DIVMTQSQKFISTSVGDRVSITCKASQSVRIAVAWFQQKPGQSPKALIYLASTRHTGVPDRFTGSGSGTDFTLTISNVQSEDLADYFCLQHWNYPYTFGGGTKLEIKR | 984 |
| vlCDR1 | QSVRIA | 985 |
| vlCDR2 | LAS | 986 |
| vlCDR3 | LQHWNYPYT | 987 |

Figure 41V

CHA.7.538_2

| What | sequence | SEQ ID NO: |
|---|---|---|
| Variable heavy (vh) domain | QVQLQQSGAELVRPGTSVKMSCKAAGYTFTNYWIGWVKQRPGHGLEWIGDIYPGGGYTNYNEKFKGKATLTADTSSSTAYMQLSSLTSEDSAIYYCASPYYGSSYGFAFWGQGTLVTVSA | 988 |
| vhCDR1 | GYTFTNYW | 989 |
| vhCDR2 | IYPGGGYT | 990 |
| vhCDR3 | ASPYYGSSYGFAF | 991 |
| Variable light (vl) domain | DIVMTQSQKFISTSVGDRVSITCKASQSVRIAVAWFQQKPGQSPKALIYLASTRHTGVPDRFTGSGSGTDFTLTISNVQSEDLADYFCLQHWNYPYTFGGGTKLEIKR | 992 |
| vlCDR1 | QSVRIA | 993 |
| vlCDR2 | LAS | 994 |
| vlCDR3 | LQHWNYPYT | 995 |

Figure 41W

CHA.7.543

| What | sequence | SEQ ID NO: |
|---|---|---|
| Variable heavy (vh) domain | QVQLKESGPGLVAPSQSLSITCTVSGFSLSGYGIKWVRQPPGKGLEWLGTIWGDGSTDYNSALKSRLSISKDNSKSQVFLKMTSLQTDDTARYYCASDSLGITFGYWGQGTLVTVSA | 996 |
| vhCDR1 | GFSLSGYG | 997 |
| vhCDR2 | IWGDGST | 998 |
| vhCDR3 | ASDSLGITFGY | 999 |
| Variable light (vl) domain | DIQMTQTTSSLSASLGDRVTISCRASQDISNYLNWYQQKPDGTVKLLIYYTSRLHSGVPSRFSGSGSGTDYSLTISNLEQEDIATYFCQQGNTLPLTFGAGTKLELK | 1000 |
| vlCDR1 | QDISNY | 1001 |
| vlCDR2 | YTS | 1002 |
| vlCDR3 | QQGNTLPLT | 1003 |

Figure 41X

CHA.7.544

| What | sequence | SEQ ID NO: |
|---|---|---|
| Variable heavy (vh) domain | QVQLKESGPGLVAPSQSLSITCTVSGFSLTSYAITWVRQPPGKGLEWLGVIWPGGGTNYNSALKSRLSISKDNSKSHLFLKMNSLQTDDTARYYCVRSYDGYLDWYFDVWGTGTTVTVSS | 1004 |
| vhCDR1 | GFSLTSYA | 1005 |
| vhCDR2 | IWPGGGT | 1006 |
| vhCDR3 | VRSYDGYLDWYFDV | 1007 |
| Variable light (vl) domain | NIVMTQSPKSMSMSVGERVTLSCKASENVGTYVSWYQQKPDQSPKLLIYGASNRYTGVPDRFTGSGSATDFTLIISSVQAEDLSDYHCGQSYSYPYTFGGGTKLEII | 1008 |
| vlCDR1 | ENVGTY | 1009 |
| vlCDR2 | GAS | 1010 |
| vlCDR3 | GQSYSYPYT | 1011 |

Figure 41Y

CHA.7.545

| What | sequence | SEQ ID NO: |
|---|---|---|
| Variable heavy (vh) domain | QIQLVQSGPDLKKPGETVKISCKAS<u>GYTFTTYG</u>MSWVKQAPGRGLKWMGW<u>INTYSGVS</u>TFPDDFKGRFAFSLETSASTAYLQINNLKNEDSATYFC<u>ARLGMGSTTGAGYFDV</u>WGTGTTVTVSS | 1012 |
| vhCDR1 | GYTFTTYG | 1013 |
| vhCDR2 | INTYSGVS | 1014 |
| vhCDR3 | ARLGMGSTTGAGYFDV | 1015 |
| Variable light (vl) domain | DIVLTQSPAIMSASPGEKVTMTCSAS<u>SSVSSWY</u>LHWYQQKSGASPKLWIY<u>GTS</u>NLASGVPARFSGSGSGTSYSLTISSVEAEDAATYYC<u>QQYRSDPYT</u>FGSGTKLEIK | 1016 |
| vlCDR1 | SSVSSWY | 1017 |
| vlCDR2 | GTS | 1018 |
| vlCDR3 | QQYRSDPYT | 1019 |

Figure 41Z

CHA.7.546

| What | sequence | SEQ ID NO: |
|---|---|---|
| Variable heavy (vh) domain | QIQLVQSGPELKKPGETVKISCKASGYTFTTYGMSWVKQAPGKGLKWMGWINTYSGVSTYADDFEGRFAFSLETSVSTAYLQINNLKNEDTATYFCARLGRGSTTGAGYLDVWGTGTTVTVSS | 1020 |
| vhCDR1 | GYTFTTYG | 1021 |
| vhCDR2 | INTYSGVS | 1022 |
| vhCDR3 | ARLGRGSTTGAGYLDV | 1023 |
| Variable light (vl) domain | DIVLTQSPAIMSASPGEKVSMTCSASSSVSSWYLHWYQQKSGASPKLWIYGTSNLASGVPARFSGSGSGTSYSLTISSVEAEDAATYYCQQYHSDPYTFGSGTKLEIK | 1024 |
| vlCDR1 | SSVSSWY | 1025 |
| vlCDR2 | GTS | 1026 |
| vlCDR3 | QQYHSDPYT | 1027 |

Figure 41AA

CHA.7.547

| What | sequence | SEQ ID NO: |
|---|---|---|
| Variable heavy (vh) domain | QIQLVQSGPDLKKPGETVKISCKASGYTFTTYGMSWVKQAPGRGLKWMGWINTYSGVSTFPDDFKGRFAFSLETSASTAYLQINNLKNEDSATYFCARLGMGSTTGAGYFDVWGTGTTVTVSS | 1028 |
| vhCDR1 | GYTFTTYG | 1029 |
| vhCDR2 | INTYSGVS | 1030 |
| vhCDR3 | ARLGMGSTTGAGYFDV | 1031 |
| Variable light (vl) domain | ENVLTQSPAIMSASLGEKVTLSCRASSSVNYMYWYQQKSDASPKLWIYYTSNLAPGVPARFSGSGSGNSYSLTISSVEGEDAATYYCQQFTSSPWTFGGGTKLEIK | 1032 |
| vlCDR1 | SSVNY | 1033 |
| vlCDR2 | YTS | 1034 |
| vlCDR3 | QQFTSSPWT | 1035 |

Figure 41BB

CHA.7.548

| What | sequence | SEQ ID NO: |
|---|---|---|
| Variable heavy (vh) domain | EVQLQQSGPELVKPGASVKISCKASGYTFTDYSMNWVKQSHGKSLEWIGDITPNNG SPNYNQKFKDKATLTVDKSSSTVYMELRSLTSEDSAVYYCASLFFDYWGHGTTLTVSS | 1036 |
| vhCDR1 | GYTFTDYS | 1037 |
| vhCDR2 | ITPNNGSP | 1038 |
| vhCDR3 | ASLFFDY | 1039 |
| Variable light (vl) domain | DIVMTQSPSSLSVSAGEKVTMSCKSSQSLLNSGNQKNYLAWYQQKPGQPPKLLIYG ASTRDSGVPDRFTGSGSGTDFTLTITSVQAEDLAVYYCQNDHTYPYTFGGGTKLEIK | 1040 |
| vlCDR1 | QSLLNSGNQKNY | 1041 |
| vlCDR2 | GAS | 1042 |
| vlCDR3 | QNDHTYPYT | 1043 |

Figure 41CC

CHA.7.549

| What | sequence | SEQ ID NO: |
|---|---|---|
| Variable heavy (vh) domain | QVQLQQPGTELVKPGASVKLSCKAS<u>GFTFTTHW</u>MHWVRQRPGQGLEWIGN<u>IYPSNGGS</u>NYNEKFKTKATLTVDRSSSTAYMHLSSLTSEDSAVYYC<u>ARRVNWDGYYFDY</u>WGQGTTLTVSS | 1044 |
| vhCDR1 | GFTFTTHW | 1045 |
| vhCDR2 | IYPSNGGS | 1046 |
| vhCDR3 | ARRVNWDGYYFDY | 1047 |
| Variable light (vl) domain | DIVMTQSQKFMSTSVGDRVSVTCKAS<u>QNVGTN</u>VAWYQQKPGQSPKLLIY<u>SAS</u>YRYSGVPDRFTGSGSGTDFTLTISNVQSEDLADYFC<u>QQYNSYPLT</u>FGGGTKLEIK | 1048 |
| vlCDR1 | QNVGTN | 1049 |
| vlCDR2 | SAS | 1050 |
| vlCDR3 | QQYNSYPLT | 1051 |

Figure 41DD

CHA.7.550

| What | sequence | SEQ ID NO: |
|---|---|---|
| Variable heavy (vh) domain | QVQLQESGTELVKPGASVKLSCKAS<u>GYTFTSYW</u>IHWVKQRPGQGLEWIGN<u>INPSN GGT</u>NYNEKFKSKAALTVDKSSSTAYMQLSSLTSEDSAVYYC<u>ARRGLPYFFDY</u>WGQG TTLTVSS | 1052 |
| vhCDR1 | GYTFTSYW | 1053 |
| vhCDR2 | INPSNGGT | 1054 |
| vhCDR3 | ARRGLPYFFDY | 1055 |
| Variable light (vl) domain | DIVMTQSQKFMSTSVGDRVSVTCKGS<u>QNVGYN</u>VAWYQQKPGQSPKALVY<u>SAS</u>DR HSGVPDRFAGSGSGTDFTLTISNVQSEDLAEYFC<u>QQYNSYPLT</u>FGAGTKLELK | 1056 |
| vlCDR1 | QNVGYN | 1057 |
| vlCDR2 | SAS | 1058 |
| vlCDR3 | QQYNSYPLT | 1059 |

Figure 42

| 1 | 2 | 3 | 4 |
|---|---|---|---|
| CPA.7.002 | CPA.7.004 | CPA.7.039 | CPA.7.050 |
| CPA.7.003 | CPA.7.009 | | |
| CPA.7.005 | CPA.7.011 | | |
| CPA.7.007 | CPA.7.014 | | |
| CPA.7.010 | CPA.7.018 | | |
| CPA.7.012 | CPA.7.022 | | |
| CPA.7.015 | CPA.7.023 | | |
| CPA.7.016 | CPA.7.034 | | |
| CPA.7.017 | CPA.7.040 | | |
| CPA.7.019 | CPA.7.045 | | |
| CPA.7.020 | CPA.7.047 | | |
| CPA.7.021 | | | |
| CPA.7.024 | | | |
| CPA.7.028 | | | |
| CPA.7.032 | | | |
| CPA.7.033 | | | |
| CPA.7.036 | | | |
| CPA.7.037 | | | |
| CPA.7.038 | | | |
| CPA.7.043 | | | |
| CPA.7.046 | | | |
| CPA.7.041 | | | |

Figure 49

| Table 1 | | $k_a$ | $k_d$ | $K_D$ |
|---|---|---|---|---|
| Fab Clone | Figure | 1/M-s | 1/s | M |
| CPA.7.021 | 50A | 2.20E+05 | 2.90E-05 | 1.32E-10 |
| CPA.7.028 | 50B | 3.08E+06 | 4.33E-04 | 1.41E-10 |
| CPA.7.019 | 50C | 8.59E+05 | 1.87E-04 | 2.18E-10 |
| CPA.7.012 | 50D | 1.51E+06 | 9.54E-04 | 6.32E-10 |
| CPA.7.007 | 50E | 3.24E+05 | 4.55E-04 | 1.41E-09 |
| CPA.7.015 | 50F | 3.13E+05 | 1.11E-03 | 3.55E-09 |
| CPA.7.050 | 50G | 7.08E+04 | 4.00E-04 | 5.65E-09 |
| CPA.7.048 | 50H | 1.35E+05 | 2.57E-03 | 1.90E-08 |
| CPA.7.049 | 50I | 1.51E+05 | 3.67E-03 | 2.44E-08 |
| CPA.7.040 | 50J | 1.33E+05 | 3.69E-03 | 2.77E-08 |
| CPA.7.020 | 50K | 1.34E+05 | 3.86E-03 | 2.88E-08 |
| CPA.7.002 | 50L | 4.59E+04 | 2.83E-03 | 6.16E-08 |
| CPA.7.022 | 50M | 3.55E+06 | 2.96E-01 | 8.33E-08 |
| CPA.7.005 | 50N | 5.22E+04 | 4.39E-03 | 8.41E-08 |
| CPA.7.004 | 50O | 2.12E+06 | 4.00E-01 | 1.89E-07 |
| CPA.7.010 | 50P | 9.06E+04 | 1.72E-02 | 1.89E-07 |
| CPA.7.008 | 50Q | 2.46E+04 | 2.03E-02 | 8.23E-07 |

Figure 52A

| Antibody | ELISA Signal | % Blocking | > 80% blocking |
|---|---|---|---|
| No mab control | 1.376 | 0 | NO |
| CPA.7.001 | 0.099 | 93 | YES |
| CPA.7.002 | 0.558 | 59 | NO |
| CPA.7.003 | 0.153 | 89 | YES |
| CPA.7.004 | 0.166 | 88 | YES |
| CPA.7.005 | 1.551 | -13 | NO |
| CPA.7.006 | 0.134 | 90 | YES |
| CPA.7.007 | 0.529 | 62 | NO |
| CPA.7.008 | 0.281 | 80 | YES |
| CPA.7.009 | 0.05 | 96 | YES |
| CPA.7.010 | 0.141 | 90 | YES |
| CPA.7.011 | 0.067 | 95 | YES |
| CPA.7.012 | 0.045 | 97 | YES |
| CPA.7.013 | 0.045 | 97 | YES |
| CPA.7.014 | 0.044 | 97 | YES |
| CPA.7.015 | 0.142 | 90 | YES |
| CPA.7.016 | 1.553 | -13 | NO |
| CPA.7.017 | 0.197 | 86 | YES |
| CPA.7.018 | 0.156 | 89 | YES |
| CPA.7.019 | 0.146 | 89 | YES |
| CPA.7.020 | 0.728 | 47 | NO |
| CPA.7.021 | 0.122 | 91 | YES |
| CPA.7.022 | 0.081 | 94 | YES |
| CPA.7.023 | 0.047 | 97 | YES |
| CPA.7.024 | 0.048 | 97 | YES |
| CPA.7.025 | 1.159 | 16 | NO |
| CPA.7.026 | 1.12 | 19 | NO |
| CPA.7.027 | 1.181 | 14 | NO |
| CPA.7.028 | 0.702 | 49 | NO |
| CPA.7.029 | 1.272 | 8 | NO |
| CPA.7.030 | 1.176 | 15 | NO |
| CPA.7.031 | 0.673 | 51 | NO |
| CPA.7.032 | 0.427 | 69 | NO |
| CPA.7.033 | 0.186 | 86 | YES |

Figure 52B

| Antibody | ELISA Signal | % Blocking | > 80% blocking |
|---|---|---|---|
| CPA.7.034 | 0.26 | 81 | YES |
| CPA.7.035 | 1.16 | 16 | NO |
| CPA.7.036 | 0.184 | 87 | YES |
| CPA.7.037 | 0.915 | 34 | NO |
| CPA.7.038 | 0.301 | 78 | NO |
| CPA.7.039 | 0.541 | 61 | NO |
| CPA.7.040 | 0.048 | 97 | YES |
| CPA.7.041 | 0.356 | 74 | NO |
| CPA.7.042 | 0.307 | 78 | NO |
| CPA.7.043 | 0.773 | 44 | NO |
| CPA.7.044 | 1.025 | 26 | NO |
| CPA.7.045 | 0.93 | 32 | NO |
| CPA.7.046 | 0.104 | 92 | YES |
| CPA.7.047 | 0.223 | 84 | YES |
| CPA.7.049 | 0.077 | 94 | YES |
| CPA.7.050 | 0.174 | 87 | YES |

Figure 54

| Cell line | ATCC No./CLS /ECACC No. | Morphology | Source |
|---|---|---|---|
| HL-60 | ATCC, CCL-240 | Leukemia | Blood |
| THP1 | ATCC, TIB-202 | Monocyte | Blood |
| KG-1 | ATCC, CCL-246 | Macrophage | Bone marrow |
| Jurkat | ATCC, TIB-152 | T Cell | Blood |
| RPMI8226 | ATCC, CCL-155 | B lymphocyte | Blood |
| DAN-G | CLS, 300162 | Epithelial | Pancreas |
| OV90 | ATCC, CRL-11732 | Epithelial | Ovary |
| NCI-H441 | ATCC, CRL-174 | Epithelial | Lung |
| TF1 | ATCC, CRL-2003 | Erythroblast | Bone Marrow |
| Capan2 | ATCC, HTB-80 | polygonal | Pancreas |
| ZR75-1 | ATCC, CRL-1500 | Epithelial | Mammary gland |
| Karpas299 | ECACC, 06072604-1VL | Lymphoma | Blood |
| NK-YTS | ATCC, CL-273 | Lymphoblast | Blood |
| H9 | ATCC, HTB-176 | Lymphoblast | Blood |
| K562 | ATCC, CCL-243 | Lymphoblast | Bone Marrow |
| NCI-H929 | ATCC, CRL-9068 | Lymphoblast | B Lymphocytes |
| BCP1 | ATCC, CRL-2294 | Lymphoblast | B Lymphoblast |
| HUT78 | ATCC, TIB-161 | Lymphoblast | Blood |
| HEK293 | ATCC, CRL-3216 | Epithelial | Kidney |

| Cell line | ATCC No. | Morphology | Source |
|---|---|---|---|
| 4T1 | CRL-2539 | Epithelial | Mammary gland |
| B16-F1 | CRL-6323 | Spindle-shaped+epithelial-like cells | Skin |
| EL4 | TIB-39 | T-lymphoblast | blood |
| E.G7-OVA | CRL-2113 | T-lymphoblast | blood |
| YAC-1 | TIB-160 | T-lymphoblast | blood |
| A20 | TIB-208 | B-lymphoblast | blood |
| P815 | TIB-64 | Mast cells | blood |
| NIH/3T3 | CRL-1658 | fibroblast | embryo |
| Sal/N | CRL-2544 | fibroblast | fibrosarcoma |
| J774A.1 | TIB-67 | Macrophage | blood |
| LL/2 | CRL-1642 | Epithelial | Lung |
| B104-1-1 | CRL-1887 | Fibroblast | Glioblastoma |
| RAW264.7 | TIB-71 | Macrophage | Abelson murine leukemia virus-induced tumor |
| P388D1 | CCL-46 | Macrophage | Lymphoblast |
| KLN205 | CRL-1453 | Epithelial | Lung |
| CT26 | CRL-2638 | Fibroblast | Colon |
| Renca | CRL-2947 | Epithelial | Kidney |

| Cell line | qRT-PCR | FACS | WB | %KD-RNA | %KD-FACS |
|---|---|---|---|---|---|
| | (PVRIG Ct / HSKG Ct) | (fold change from isotype) | | | |
| OV90 | Undetermined/24.582 | NT | NT | | |
| DAN-G | Undetermined/23.184 | NT | NT | | |
| Jurkat | 31.552/24.107 | 14 | + | 65 | 82 |
| KG1 | Undetermined/23.197 | NT | NT | | |
| HUT78 | 29.626/23.192 | X | NT | | |
| RPMI8226 | 33.995/24.887 | NT | NT | | |
| NCI-H929 | Undetermined/25.228 | NT | NT | | |
| ZR75-1 | Undetermined/23.889 | X | X | | |
| Capan2 | Undetermined/28.714 | X | NT | | |
| NCI-H441 | Undetermined/24.886 | NT | NT | | |
| TF1 | 38.133/25.988 | NT | NT | | |
| K562 | 36.400/26.160 | NT | NT | | |
| BCP1 | Undetermined/25.860 | NT | NT | | |
| THP1 | 34.678/24.615 | NT | NT | | |
| HL60 | 31.133/25.955 | NT | NT | | |
| Karpas299 | NT | X | NT | | |
| NK-YTS | NT | X | NT | | |

Figure 62

| Cell line | qRT-PCR (PVRIG Ct / HSKG Ct) | FACS (fold change from isotype) | WB | %KD-RNA | %KD-FACS |
|---|---|---|---|---|---|
| 4T1 | 34.722/19.013 | NT | NT | | |
| B16-F1 | 38.531/18.549 | NT | NT | | |
| EL4 | 34.033/18.740 | NT | NT | | |
| YAC-1 | 36.058/19.646 | NT | NT | | |
| P815 | 38.159/19.417 | NT | NT | | |
| E.G7-OVA | 38.219/19.477 | NT | NT | | |
| NIH3T3 | 29.94 / 21.25 | X | NT | | |
| SAI/N | 31.389/18.789 | X | NT | | |
| J774A.1 | 31.487/18.996 | X | NT | | |
| A20 | 35.520/18.740 | NT | NT | | |
| LL/2 | 33.401/18.732 | NT | NT | | |
| B104-1-1 | 32.839/19.686 | NT | NT | | |
| RAW264.7 | 34.116/19.445 | NT | NT | | |
| P388D1 | 33.421/18.947 | NT | NT | | |
| KLN205 | 33.698/19.472 | NT | NT | | |
| Renca | 31.237/19.632 | X | NT | | |

Figure 63A

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.001 | GGTFSSYA | 1060 | IIPIFGTA | 1061 | AREEVSSPYGMDV | 1062 | TGAVTSGHY | 1063 | DTG | 1064 | LSYSGASWV | 1065 |
| CPA.7.002 | GGTFSSSA | 1066 | IIPIYGIT | 1067 | ARDDTARRVRGVPYYYYA MDV | 1073 | QGIGNY | 1068 | SAS | 1070 | QQLKDYPIT | 1071 |
| CPA.7.003 | GFSLSHFS | 1072 | FDPEEGGT | 1073 | ATGWYSSGWPVDY | 1073 | QSLDSSGYNY | 1074 | LGS | 1076 | MQALQTPIT | 1077 |
| CPA.7.004 | GYTLTELS | 1078 | FDPEDGET | 1079 | ATVSRVRGVINYYYYMDV | 1079 | QSLLYRNGNNY | 1080 | LGS | 1082 | MQALQTPPT | 1083 |
| CPA.7.005 | GGTFSSSA | 1084 | IIPIYGIT | 1085 | ARDDTARRVRGVPYYYYA MDV | 1085 | QSVDSS | 1086 | DAS | 1088 | QQYKDWPFT | 1089 |
| CPA.7.006 | GGTFGTYA | 1090 | ITPISATI | 1091 | ARGFEYSDGLLDD | 1091 | QSLFYSDDGNTY | 1092 | RLS | 1094 | MQHMEFPLT | 1095 |
| CPA.7.007 | GGSISSSSYY | 1096 | IYYSGST | 1097 | ARGAWELRLGDWFDP | 1097 | SSNIGAGYD | 1098 | GNN | 1100 | QSYDSSLSIYVV | 1101 |
| CPA.7.008 | SGSISSTNW | 1102 | IYHSGST | 1103 | ARVGPAAIYY | 1103 | SNNVGYEG | 1104 | RNN | 1106 | SAWDSSLNAVV | 1107 |
| CPA.7.009 | GYTLTELS | 1108 | FDPEDGET | 1109 | ATAKPGIAVAGQNYYYYM DV | 1109 | QSLLYRNGNNY | 1110 | LGS | 1112 | MQALQTPPT | 1113 |
| CPA.7.010 | GFTFSSYA | 1114 | ISYDGSNK | 1115 | ASSPIGYSYGYWGGMDV | 1115 | SGIDVRTNK | 1116 | FQSDSDK | 1118 | LIWHTSGWV | 1119 |
| CPA.7.011 | GYTLTELS | 1120 | FDPEDGET | 1121 | ATGPAAAGVGYYYYMDV | 1121 | QSLLYRNGYNY | 1122 | LGS | 1124 | MQALQTPPT | 1125 |
| CPA.7.012 | GFTFSSYA | 1126 | ISYDGSNK | 1127 | ARDVMVYCSSTSCYFYGM DV | 1127 | QDIRDY | 1128 | DAS | 1130 | QQFENLPIT | 1131 |
| CPA.7.013 | GYTLTELS | 1132 | FDPEDGET | 1133 | ATGGYSSGFNYYYYYMDV | 1133 | QSLLYRNGMNY | 1134 | LGS | 1136 | MQALQTPPT | 1137 |
| CPA.7.014 | GYTLTELS | 1138 | FDPEDGET | 1139 | AIGVTYYYGMDV | 1139 | QSLLYSNGNNF | 1140 | LGS | 1142 | MQALQTPPT | 1143 |
| CPA.7.015 | GFTFSSYG | 1144 | IRYDGSNK | 1145 | ARDLFDFWWDGMDV | 1145 | QSVSSMY | 1146 | GAS | 1148 | QQYSSPMYT | 1149 |

Figure 63B

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.016 | GGTFSSSA | 1150 | IIPIYGIT | 1151 | ARDDTARRVRGVPYYYYAMDV | 1152 | QSVSSY | 1153 | DAS | 1154 | QQYDDWPQT | 1155 |
| CPA.7.017 | GGTFNNYG | 1156 | IIPLFGTT | 1157 | ARDRMAADGMAVFDY | 1158 | SSNIGRHF | 1159 | KND | 1160 | SSWDAALNGYV | 1161 |
| CPA.7.018 | GYTLTELS | 1162 | FDPEDGET | 1163 | ATEVPMVRGARRYYYYMDV | 1164 | QTLLYINENNY | 1165 | LGS | 1166 | MQGLQTPPT | 1167 |
| CPA.7.019 | GGSISNSNYY | 1168 | IYYSGST | 1169 | ARGAWELSLGDWFDP | 1170 | SSNIGAGYD | 1171 | GNN | 1172 | QSYDSSLSVYVV | 1173 |
| CPA.7.020 | GGTFSSSA | 1174 | IIPIYGIT | 1175 | ARDDTARRVRGVPYYYYAMDV | 1176 | QNVYGE | 1177 | DTF | 1178 | QQRRDWPIT | 1179 |
| CPA.7.021 | GFTFGTSS | 1180 | ISFDGTEI | 1181 | AKGSGNIYFYSGMDV | 1182 | QSISGW | 1183 | ETS | 1184 | QQYYSYPLT | 1185 |
| CPA.7.022 | GYTLTELS | 1186 | FDPEDGET | 1187 | ATGVPAAIGVYYYYYMDV | 1188 | QSLLYSNGYNY | 1189 | LGS | 1190 | MQALQSPVT | 1191 |
| CPA.7.023 | GYTLTELS | 1192 | FDPEDGET | 1193 | ATDSRDGPAARGGYYYYMDV | 1194 | QSLLYNGYNY | 1195 | LGS | 1196 | MQALQTPPT | 1197 |
| CPA.7.024 | GGTFSSYA | 1198 | IIPIFGTA | 1199 | ARDAYYYDSSGYYNPDAFDI | 1200 | QSLLHSNGYNY | 1201 | LGS | 1202 | MQGLQTPRT | 1203 |
| CPA.7.025 | GFSLTSGGMS | 1204 | IDWNDDK | 1205 | ARIRGMTWGFDS | 1206 | QSVSSSY | 1207 | GAS | 1208 | QQYGTTPPA | 1209 |
| CPA.7.026 | GYTFTAYY | 1210 | INPNSGGT | 1211 | ARDGAFYYGSENYYNAGWFDP | 1212 | QSLLSGNGYNY | 1213 | LGS | 1214 | MQALKSPLT | 1215 |
| CPA.7.027 | GYTFTNYY | 1216 | INPSGGT | 1217 | ARAGLGYNWNYAPSGMDV | 1218 | SSDVGGYNY | 1219 | EVS | 1220 | SSYAGSNNLV | 1221 |
| CPA.7.028 | GGSISSSYY | 1222 | IYYSGST | 1223 | ARGAWELRLGDWFDP | 1224 | SSNIGAGYD | 1225 | GYS | 1226 | QSYDSSLSVYVV | 1227 |
| CPA.7.029 | GFTFDDYA | 1228 | ISWNSGSI | 1229 | AKDVNRILVAGMVDY | 1230 | QSLLHSNGYNY | 1231 | LGS | 1232 | MQGLQTPPT | 1233 |
| CPA.7.030 | RFTFEDYA | 1234 | ISWKSGGI | 1235 | VKDPTLVATDRAFNI | 1236 | QSLLHSNGYNY | 1237 | LGS | 1238 | MQYLQTPDT | 1239 |

Figure 63C

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.031 | GGTFSSSA | 1240 | IIPIYGIT | 1241 | ARDDTARRVRGVPYYYYAMDV | 1242 | QSLLDSDGNIH | 1243 | TLS | 1244 | MQRKEFPLT | 1244 |
| CPA.7.032 | GFTFSSYG | 1246 | ISYDGSNK | 1247 | AKEDRLRFLEWLFYGMDV | 1248 | HDIYTY | 1249 | DAS | 1250 | QQYDNHPPEVT | 1250 |
| CPA.7.033 | GGTFSSSA | 1252 | IIPIYGIT | 1253 | ARDDTARRVRGVPYYYYAMDV | 1254 | QDIDDD | 1255 | EAS | 1256 | LQHDNLPLT | 1256 |
| CPA.7.034 | GYTLTELS | 1258 | FDPEDGET | 1259 | ATEDPGPVAGPYYYYGMDV | 1260 | QSLLYINGYHY | 1261 | LGS | 1262 | MQALQTPPT | 1262 |
| CPA.7.035 | GYMFTNYP | 1264 | INAGTGNT | 1265 | AREGMFYYGLESYYKGGWFDP | 1266 | QSLLHRNGYNY | 1267 | LAS | 1268 | MQALQTPLT | 1268 |
| CPA.7.036 | GGTFSSSA | 1270 | IIPIYGIT | 1271 | ARDDTARRVRGVPYYYYAMDV | 1272 | QSLLDSDDGNTY | 1273 | TLS | 1274 | MQRLQFPLT | 1274 |
| CPA.7.037 | TYTFTTYY | 1276 | IYPSGGNT | 1277 | VRDQNYYYSAMDV | 1278 | QDIRNY | 1279 | DAS | 1280 | QQFENLPIT | 1280 |
| CPA.7.038 | GGTFSSSA | 1282 | IIPIYGIT | 1283 | ARDDTARRVRGVPYYYYAMDV | 1284 | RDISDS | 1285 | DAS | 1286 | HQYDNLPLT | 1286 |
| CPA.7.039 | GFNFRGYA | 1288 | ISGSGGTT | 1289 | AQSYAQIGYGGHIDH | 1290 | SGIDVATYM | 1291 | YKSDSDK | 1292 | LIWHGSHYV | 1292 |
| CPA.7.040 | GYTLTELS | 1294 | FDPEDGET | 1295 | ATGVPAAIGVYYYYYMDV | 1296 | QSLLYRNGYNY | 1297 | WGS | 1298 | MQAVQNPPT | 1298 |
| CPA.7.041 | GGTFSSSA | 1300 | IIPIYGIT | 1301 | ARDDTARRVRGVPYYYYAMDV | 1302 | QNIDSS | 1303 | YAS | 1304 | HQSSSLPLT | 1304 |
| CPA.7.042 | GGTFSSSA | 1306 | IIPIYGIT | 1307 | ARDDTARRVRGVPYYYYAMDV | 1308 | QSVYNNY | 1309 | DAS | 1310 | QQYNSWPPYT | 1310 |
| CPA.7.043 | GGTFSSYA | 1312 | IIPIFGTA | 1313 | ARDAYYDSSGYYNPDAFDI | 1314 | QSLLYSNGYNY | 1315 | LGS | 1316 | MQARQTPYT | 1316 |
| CPA.7.044 | GGTFSSSA | 1318 | IIPIYGIT | 1319 | ARDDTARRVRGVPYYYYAMDV | 1320 | ESVTTF | 1321 | DAS | 1322 | HQHTNWPLT | 1322 |
| CPA.7.045 | GYTLTELS | 1324 | FDPEDGET | 1325 | ATEVGYCSGGSCYSYYYGMDV | 1326 | QSLLYRNGHNF | 1327 | LGS | 1328 | MQALQTPPT | 1328 |
| CPA.7.046 | GGTFSSSA | 1330 | IIPIYGIT | 1331 | ARDDTARRVRGVPYYYYAMDV | 1332 | QTMNNY | 1333 | DAS | 1334 | QQYGDWLPIT | 1335 |

Figure 63D

| Name | Hcdr1 | SEQ ID NO: | Hcdr2 | SEQ ID NO: | Hcdr3 | SEQ ID NO: | Lcdr1 | SEQ ID NO: | Lcdr2 | SEQ ID NO: | Lcdr3 | SEQ ID NO: |
|---|---|---|---|---|---|---|---|---|---|---|---|---|
| CPA.7.047 | GYTLTELS | 1336 | FDPEDGET | 1337 | ATAFPEATSYYYMDV | 1338 | QSLLYRNGYNY | 1339 | WGS | 1340 | MQAVQNPPT | 1341 |
| CPA.7.049 | GGTFSSSA | 1342 | IIPIYGIT | 1343 | ARDDTARRVRGVPYYYYAMDV | 1344 | RSLLDSDDGNTH | 1345 | SLS | 1346 | MQRKEFPLT | 1347 |
| CPA.7.050 | GGTFSSYA | 1348 | IIPIFGTA | 1349 | ARGPWYYDSSGYSSYAYYMDV | 1350 | QSLLHSDGYNY | 1351 | LGS | 1352 | MQALHTPGVT | 1353 |

Figure 64A

| Disease | CD8A | CD4 | CD3G | PD-1 |
|---|---|---|---|---|
| Kidney renal clear cell carcinoma | 0.89 | 0.75 | 0.83 | 0.9 |
| Sarcoma | 0.87 | 0.64 | 0.88 | 0.82 |
| Liver hepatocellular carcinoma | 0.86 | 0.6 | 0.78 | 0.63 |
| Skin Cutaneous Melanoma | 0.86 | 0.77 | 0.87 | 0.89 |
| Head and Neck squamous cell carcinoma | 0.85 | 0.72 | 0.82 | 0.86 |
| Breast invasive carcinoma | 0.84 | 0.67 | 0.81 | 0.85 |
| Testicular Germ Cell Tumors | 0.84 | 0.66 | 0.88 | 0.84 |
| Stomach adenocarcinoma | 0.8 | 0.66 | 0.78 | 0.78 |
| Mesothelioma | 0.79 | 0.63 | 0.8 | 0.67 |
| Thyroid carcinoma | 0.79 | 0.72 | 0.87 | 0.83 |
| Lung squamous cell carcinoma | 0.78 | 0.65 | 0.77 | 0.81 |
| Kidney Chromophobe | 0.77 | 0.6 | 0.7 | 0.71 |
| Pancreatic adenocarcinoma | 0.77 | 0.57 | 0.76 | 0.8 |
| Rectum adenocarcinoma | 0.77 | 0.69 | 0.68 | 0.72 |
| Uterine Corpus Endometrial Carcinoma | 0.77 | 0.68 | 0.75 | 0.7 |

Figure 64B

| | | | |
|---|---|---|---|
| Bladder Urothelial Carcinoma | 0.76 | 0.68 | 0.81 | 0.82 |
| Lung adenocarcinoma | 0.76 | 0.52 | 0.74 | 0.77 |
| Prostate adenocarcinoma | 0.76 | 0.73 | 0.72 | 0.76 |
| Cervical squamous cell carcinoma and endocervical adenocarcinoma | 0.74 | 0.64 | 0.76 | 0.7 |
| Colon adenocarcinoma | 0.74 | 0.71 | 0.75 | 0.67 |
| Kidney renal papillary cell carcinoma | 0.69 | 0.51 | 0.66 | 0.61 |
| Uterine Carcinosarcoma | 0.69 | 0.4 | 0.59 | 0.58 |
| Ovarian serous cystadenocarcinoma | 0.67 | 0.64 | 0.66 | 0.6 |
| Esophageal carcinoma | 0.63 | 0.57 | 0.66 | 0.65 |
| Acute Myeloid Leukemia | 0.58 | -0.15 | 0.56 | 0.29 |
| Pheochromocytoma and Paraganglioma | 0.57 | 0.33 | 0.42 | 0.49 |
| Adrenocortical carcinoma | 0.55 | 0.49 | 0.66 | 0.64 |

Figure 65

| Antibodies | Isotype | Conjugated to | Manufacturer | Catalog number | concentration (ug/ul) | Staining concentration |
| --- | --- | --- | --- | --- | --- | --- |
| Anti-human PVRIG - CPA.7.021 | Human IgG2 | AF-647 | Compugen | CPA.7.021 | 0.2 | 7.5 ug/ml |
| Human IgG2 isotype control | Human IgG2 | AF-647 | Compugen | | 0.2 | 7.5 ug/ml |
| Anti-CD4 | mIgG1 | FITC | Biolegend | 300506 | 0.4 | 4 ug/ml |
| Anti-CD8 | mIgG1 | FITC | Biolegend | 300906 | 0.15 | 1.5 ug/ml |
| Anti-CD137 | mIgG1 | PE | Biolegend | 309804 | 0.2 | 2 ug/ml |
| Anti-PD1 | mIgG1 | APC-cy7 | Biolegend | 329922 | 0.2 | 4 ug/ml |
| isotype control | mIgG1 | PE | Biolegend | 400112 | 0.4 | 2 ug/ml |
| isotype control | mIgG1 | APC-cy7 | Biolegend | 400128 | 0.2 | 4 ug/ml |

Figure 66A

| SEQ ID NO: | | CH1 | | | | | | | | | | | | | | | | | | | |
|---|---|---|---|---|---|---|---|---|---|---|---|---|---|---|---|---|---|---|---|---|---|
| | EU Index | 118 | 119 | 120 | 121 | 122 | 123 | 124 | 125 | 126 | 127 | 128 | 129 | 130 | 131 | 132 | 133 | 134 | 135 | 136 | 137 | 138 |
| 1354 (IgG1) | IgG1 | A | S | T | K | G | P | S | V | F | P | L | A | P | S | S | K | S | T | S | G | G |
| 1355 (IgG2) | IgG2 | A | S | T | K | G | P | S | V | F | P | L | A | P | C | S | R | S | T | S | E | S |
| 1356 (IgG3) | IgG3 | A | S | T | K | G | P | S | V | F | P | L | A | P | C | S | R | S | T | S | G | G |
| 1357 (IgG4) | IgG4 | A | S | T | K | G | P | S | V | F | P | L | A | P | C | S | R | S | T | S | E | S |

| EU Index | 139 | 140 | 141 | 142 | 143 | 144 | 145 | 146 | 147 | 148 | 149 | 150 | 151 | 152 | 153 | 154 | 155 | 156 | 157 | 158 | 159 |
|---|---|---|---|---|---|---|---|---|---|---|---|---|---|---|---|---|---|---|---|---|---|
| IgG1 | T | A | A | L | G | C | L | V | K | D | Y | F | P | E | P | V | T | V | S | W | N |
| IgG2 | T | A | A | L | G | C | L | V | K | D | Y | F | P | E | P | V | T | V | S | W | N |
| IgG3 | T | A | A | L | G | C | L | V | K | D | Y | F | P | E | P | V | T | V | S | W | N |
| IgG4 | T | A | A | L | G | C | L | V | K | D | Y | F | P | E | P | V | T | V | S | W | N |

| EU Index | 160 | 161 | 162 | 163 | 164 | 165 | 166 | 167 | 168 | 169 | 170 | 171 | 172 | 173 | 174 | 175 | 176 | 177 | 178 | 179 | 180 |
|---|---|---|---|---|---|---|---|---|---|---|---|---|---|---|---|---|---|---|---|---|---|
| IgG1 | S | G | A | L | T | S | G | V | H | T | F | P | A | V | L | Q | S | S | G | L | Y |
| IgG2 | S | G | A | L | T | S | G | V | H | T | F | P | A | V | L | Q | S | S | G | L | Y |
| IgG3 | S | G | A | L | T | S | G | V | H | T | F | P | A | V | L | Q | S | S | G | L | Y |
| IgG4 | S | G | A | L | T | S | G | V | H | T | F | P | A | V | L | Q | S | S | G | L | Y |

| EU Index | 181 | 182 | 183 | 184 | 185 | 186 | 187 | 188 | 189 | 190 | 191 | 192 | 193 | 194 | 195 | 196 | 197 | 198 | 199 | 200 | 201 |
|---|---|---|---|---|---|---|---|---|---|---|---|---|---|---|---|---|---|---|---|---|---|
| IgG1 | S | L | S | S | V | V | T | V | P | S | S | S | L | G | T | Q | T | Y | I | C | N |
| IgG2 | S | L | S | S | V | V | T | V | P | S | S | N | F | G | T | Q | T | Y | T | C | N |
| IgG3 | S | L | S | S | V | V | T | V | P | S | S | S | L | G | T | Q | T | Y | T | C | N |
| IgG4 | S | L | S | S | V | V | T | V | P | S | S | S | L | G | T | K | T | Y | T | C | N |

| EU Index | 202 | 203 | 204 | 205 | 206 | 207 | 208 | 209 | 210 | 211 | 212 | 213 | 214 | 215 | 216 | 217 | 218 | 219 | 220 |
|---|---|---|---|---|---|---|---|---|---|---|---|---|---|---|---|---|---|---|---|
| IgG1 | V | N | H | K | P | S | N | T | K | V | D | K | K | V | E | P | K | S | C |
| IgG2 | V | D | H | K | P | S | N | T | K | V | D | K | T | V | E | R | K | C | C |
| IgG3 | V | N | H | K | P | S | N | T | K | V | D | K | R | V | E | L | K | T | P |
| IgG4 | V | D | H | K | P | S | N | T | K | V | D | K | R | V | E | S | K | Y | G |

| | Hinge | | | | | | Fc > | |
|---|---|---|---|---|---|---|---|---|
| EU Index | 231 | 222 | 223 | 224 | 225 | 226 | 227 | 228 | |
| IgG1 | D | | K | T | H | T | C | P | P |
| IgG2 | E | R | K | C | C | V | E | C | P | P |
| IgG3 | L | K | T | P | L | G | D | T | T | H | T | C | P | R | C | P | E | P | K | S | C | D | T | P | P |
| IgG4 | E | S | K | Y | G | P | P | C | P | S |

| EU Index | |
|---|---|
| IgG1 | |
| IgG2 | |
| IgG3 | P C P R C P E P K S C D T P P C P R C P |
| IgG4 | |

| | | | | | | | Fc > | | |
|---|---|---|---|---|---|---|---|---|---|
| EU Index | | | | | | | 229 | 230 | 231 | 232 | 233 | 234 | 235 | 236 |
| IgG1 | | | | | | | | C | P | A | P | E | L | L | G |
| IgG2 | | | | | | | | C | P | A | P | P | V | A | G |
| IgG3 | E P K S C D T P P P C P R | C | P | A | P | E | L | L | G |
| IgG4 | | | | | | | | C | P | A | P | E | F | L | G |

Figure 66B

```
              CH2
SEQ ID NO:    EU Index 237 238 239 240 241 242 243 244 245 246 247 248 249 250 251 252 253 254 255 256 257
1354 (IgG1)   IgG1      G   P   S   V   F   L   F   P   P   K   P   K   D   T   L   M   I   S   R   T   P
1355 (IgG2)   IgG2      G   P   S   V   F   L   F   P   P   K   P   K   D   T   L   M   I   S   R   T   P
1356 (IgG3)   IgG3      G   P   S   V   F   L   F   P   P   K   P   K   D   T   L   M   I   S   R   T   P
1357 (IgG4)   IgG4      G   P   S   V   F   L   F   P   P   K   P   K   D   T   L   M   I   S   R   T   P EU Index 258 259 260 261 262 263 264 265 266 267 268 269 270 271 272 273 274 275 276 277 278
              IgG1      E   V   T   C   V   V   V   D   V   S   H   E   D   P   E   V   K   F   N   W   Y
              IgG2      E   V   T   C   V   V   V   D   V   S   H   E   D   P   E   V   █   F   N   W   Y
              IgG3      E   V   T   C   V   V   V   D   V   S   H   E   D   P   E   V   █   F   █   W   Y
              IgG4      E   V   T   C   V   V   V   D   V   S   █   E   D   P   E   V   █   F   N   W   Y EU Index 279 280 281 282 283 284 285 286 287 288 289 290 291 292 293 294 295 296 297 298 299
              IgG1      V   D   G   V   E   V   H   N   A   K   T   K   P   R   E   E   Q   Y   N   S   T
              IgG2      V   D   G   V   E   V   H   N   A   K   T   K   P   R   E   E   Q   █   N   S   T
              IgG3      V   D   G   V   E   V   H   N   A   K   T   K   P   R   E   E   Q   Y   N   S   T
              IgG4      V   D   G   V   E   V   H   N   A   K   T   K   P   R   E   E   Q   █   N   S   T EU Index 300 301 302 303 304 305 306 307 308 309 310 311 312 313 314 315 316 317 318 319 320
              IgG1      Y   R   V   V   S   V   L   T   V   L   H   Q   D   W   L   N   G   K   E   Y   K
              IgG2      █   R   V   V   S   V   L   T   V   █   H   Q   D   W   L   N   G   K   E   Y   K
              IgG3      █   R   V   V   S   V   L   T   V   L   H   Q   D   W   L   N   G   K   E   Y   K
              IgG4      Y   R   V   V   S   V   L   T   V   L   H   Q   D   W   L   N   G   K   E   Y   K EU Index 321 322 323 324 325 326 327 328 329 330 331 332 333 334 335 336 337 338 339 340
              IgG1      C   K   V   S   N   K   A   L   P   A   P   I   E   K   T   I   S   K   A   K
              IgG2      C   K   V   S   N   K   █   L   P   A   P   I   E   K   T   I   S   K   █   K
              IgG3      C   K   V   S   N   K   A   L   P   A   P   I   E   K   T   I   S   K   █   K
              IgG4      C   K   V   S   N   K   █   L   P   █   █   I   E   K   T   I   S   K   A   K CH3
              EU Index 341 342 343 344 345 346 347 348 349 350 351 352 353 354 355 356 357 358 359 360 361
              IgG1      G   Q   P   R   E   P   Q   V   Y   T   L   P   P   S   R   D   E   L   T   K   N
              IgG2      G   Q   P   R   E   P   Q   V   Y   T   L   P   P   S   R   █   E   █   T   K   N
              IgG3      G   Q   P   R   E   P   Q   V   Y   T   L   P   P   S   R   █   E   █   T   K   N
              IgG4      G   Q   P   R   E   P   Q   V   Y   T   L   P   P   S   █   █   E   █   T   K   N EU Index 362 363 364 365 366 367 368 369 370 371 372 373 374 375 376 377 378 379 380 381 382
              IgG1      Q   V   S   L   T   C   L   V   K   G   F   Y   P   S   D   I   A   V   E   W   E
              IgG2      Q   V   S   L   T   C   L   V   K   G   F   Y   P   S   D   I   A   V   E   W   E
              IgG3      Q   V   S   L   T   C   L   V   K   G   F   Y   P   S   D   I   A   V   E   W   E
              IgG4      Q   V   S   L   T   C   L   V   K   G   F   Y   P   S   D   I   A   V   E   W   E EU Index 383 384 385 386 387 388 389 390 391 392 393 394 395 396 397 398 399 400 401 402 403
              IgG1      S   N   G   Q   P   E   N   N   Y   K   T   T   P   P   V   L   D   S   D   G   S
              IgG2      S   N   G   Q   P   E   N   N   Y   K   T   T   P   P   █   L   D   S   D   G   S
              IgG3      S   █   G   Q   P   E   N   N   Y   █   T   T   P   P   █   L   D   S   D   G   S
              IgG4      S   N   G   Q   P   E   N   N   Y   K   T   T   P   P   V   L   D   S   D   G   S
```

Figure 66C

| SEQ ID NO: | EU index | 404 | 405 | 406 | 407 | 408 | 409 | 410 | 411 | 412 | 413 | 414 | 415 | 416 | 417 | 418 | 419 | 420 | 421 | 422 | 423 | 424 |
|---|---|---|---|---|---|---|---|---|---|---|---|---|---|---|---|---|---|---|---|---|---|---|
| 1354 (IgG1) | IgG1 | F | F | L | Y | S | K | L | T | V | D | K | S | R | W | Q | Q | G | N | V | F | S |
| 1355 (IgG2) | IgG2 | F | F | L | Y | S | K | L | T | V | D | K | S | R | W | Q | Q | G | N | V | F | S |
| 1356 (IgG3) | IgG3 | F | F | L | Y | S | K | L | T | V | D | K | S | R | W | Q | Q | G | N | ▓ | F | S |
| 1357 (IgG4) | IgG4 | F | F | L | Y | S | ▓ | L | T | V | D | K | S | R | W | Q | ▓ | G | N | V | F | S |

| EU index | 425 | 426 | 427 | 428 | 429 | 430 | 431 | 432 | 433 | 434 | 435 | 436 | 437 | 438 | 439 | 440 | 441 | 442 | 443 | 444 | 445 |
|---|---|---|---|---|---|---|---|---|---|---|---|---|---|---|---|---|---|---|---|---|---|
| IgG1 | C | S | V | M | H | E | A | L | H | N | H | Y | T | Q | K | S | L | S | L | S | P |
| IgG2 | C | S | V | M | H | E | A | L | H | N | H | Y | T | Q | K | S | L | S | L | S | P |
| IgG3 | C | S | V | M | H | E | A | L | H | N | ▓ | Y | T | Q | K | S | L | S | L | S | P |
| IgG4 | C | S | V | M | H | E | A | L | H | N | H | Y | T | Q | K | S | L | S | L | S | ▓ |

| EU index | 446 | 447 |
|---|---|---|
| IgG1 | G | K |
| IgG2 | G | K |
| IgG3 | G | K |
| IgG4 | G | K |

Figure 67

PVRIG ECD Fragment A    TTLAVLHPERGIRQWAPARQA (SEQ ID NO: 1358)

PVRIG ECD Fragment B    TTLAVLHPERGIRQWAPARQARWETQSSISLILE (SEQ ID NO: 1359)

PVRIG ECD Fragment C   ARQARWETQSSISLILE (SEQ ID NO: 1360)

PVRIG ECD Fragment D   TFCCKFASFPEGSWEA (SEQ ID NO: 1361)

PVRIG ECD Fragment E   TFCCKFASFPEGSWEACGSLPPSS (SEQ ID NO: 1362)

PVRIG ECD Fragment F    EATELSSFTIRCGFL (SEQ ID NO: 1363)

PVRIG ECD Fragment G      EVWVQVRMEATELSSFTIRCGF (SEQ ID NO: 1364)

PVRIG ECD Fragment H   FTIRCGFLGSGSISLVTVS (SEQ ID NO: 1365)

PVRIG ECD Fragment I   SISLVTVSWGGPNGAGGTTLAVLH (SEQ ID NO: 1366)

PVRIG ECD Fragment J    SISLILEGSGASSPCANTTFCCKFAS (SEQ ID NO: 1367)

Figure 79A

| Antibody (mIgG) | EC$_{50}$ (HEK OE, nM) | HEK OE/par (3.3ug/ml, gMFIr) | Jurkat (3.3ug/ml, gMFIr) |
|---|---|---|---|
| CHA.7.502 | 40.18 | 71.99 | 6.21 |
| CHA.7.503 | 1.05 | 260.98 | 23.59 |
| CHA.7.506 | No binding | 0.76 | No binding |
| CHA.7.508 | 3.30 | 45.86 | 6.50 |
| CHA.7.510 | 92.81 | 16.32 | 4.19 |
| CHA.7.512 | 52.99 | 5.12 | 1.47 |
| CHA.7.514 | 5.31 | 49.82 | 7.67 |
| CHA.7.516 | 0.79 | 37.90 | 5.73 |
| CHA.7.518 | 0.36 | 42.24 | 6.58 |
| CHA.7.520 | No binding | 1.01 | No binding |
| CHA.7.522 | 91.44 | 10.12 | 2.99 |
| CHA.7.524 | 0.46 | 48.33 | 7.87 |
| CHA.7.525 | 3.05 | 41.86 | 4.30 |
| CHA.7.526 | 2.99 | 47.28 | 3.98 |
| CHA.7.527 | No binding | 0.98 | No binding |
| CHA.7.528 | 7.31 | 44.88 | 6.17 |
| CHA.7.530 | 0.33 | 51.14 | 8.04 |
| CHA.7.534 | 1.87 | 43.72 | 5.05 |
| CHA.7.535 | 3.67 | 40.44 | 2.79 |
| CHA.7.537 | 2.47 | 36.61 | 5.53 |

Figure 79B

| | | | |
|---|---|---|---|
| CHA.7.538 | 0.52 | 35.80 | 7.37 |
| CHA.7.543 | 0.52 | 49.81 | 6.73 |
| CHA.7.544 | 0.76 | 42.60 | 5.68 |
| CHA.7.545 | 0.76 | 44.31 | 6.53 |
| CHA.7.546 | 0.61 | 43.14 | 6.42 |
| CHA.7.547 | 14.37 | 10.94 | 1.02 |
| CHA.7.548 | 0.27 | 45.26 | 7.37 |
| CHA.7.549 | 2.60 | 29.71 | 2.23 |
| CHA.7.550 | 1.34 | 27.72 | 2.10 |

Figure 80A

| Antibody (mIgG) | Human CD56 int. NK (gMFIr, 10ug/ml) | Human CD8+ T cells (gMFIr, 10ug/ml) | Expi cyno OE/par (gMFIr, 3.3ug/ml) | Cyno NK cells (gMFIr, 10ug/ml) | Cyno CD8+ T cells (gMFIr, 10ug/ml) |
|---|---|---|---|---|---|
| CHA.7.502 | 1.97 | 1.41 | 60.49 | Not tested | Not tested |
| CHA.7.503 | 3.15 | 1.96 | 106.3 | Not tested | Not tested |
| CHA.7.506 | Not tested | Not tested | 0.77 | Not tested | Not tested |
| CHA.7.508 | 3.6 | 4.09 | 41.49 | Not tested | Not tested |
| CHA.7.510 | 3.13 | 2.73 | 38.21 | Not tested | Not tested |
| CHA.7.512 | 1.30 | 1.15 | 8.96 | Not tested | Not tested |
| CHA.7.514 | 4.16 | 5.15 | 65.20 | Not tested | Not tested |
| CHA.7.516 | 4.22 | 4.09 | 60.05 | 1.76 | 2.09 |
| CHA.7.518 | 5.08 | 6.69 | 83.51 | 1.92 | 2.09 |
| CHA.7.520 | 1.13 | 1.04 | Not tested | Not tested | Not tested |
| CHA.7.522 | 2.06 | 1.90 | 27.24 | Not tested | Not tested |

Figure 80B

| | | | | | |
|---|---|---|---|---|---|
| CHA.7.524 | 5.50 | 6.12 | 66.32 | 1.78 | 2.02 |
| CHA.7.525 | 1.98 | 1.76 | 0.85 | Not tested | Not tested |
| CHA.7.526 | 2.08 | 1.71 | 0.79 | Not tested | Not tested |
| CHA.7.527 | 1.16 | 0.99 | Not tested | Not tested | Not tested |
| CHA.7.528 | 3.08 | 3.63 | 12.2 | 1.21 | 1.18 |
| CHA.7.530 | 6.04 | 6.47 | 60.80 | 1.73 | 1.89 |
| CHA.7.534 | 2.60 | 1.96 | 46.27 | Not tested | Not tested |
| CHA.7.535 | 2.24 | 1.28 | 0.82 | Not tested | Not tested |
| CHA.7.537 | 3.90 | 3.41 | 1.55 | 1.18 | 1.19 |
| CHA.7.538 | 6.49 | 6.17 | 15.16 | 1.36 | 1.45 |
| CHA.7.543 | 4.48 | 4.33 | 0.83 | 1.35 | 1.39 |
| CHA.7.544 | 2.36 | 2.54 | 61.09 | Not tested | Not tested |
| CHA.7.545 | 2.54 | 2.82 | 0.91 | Not tested | Not tested |
| CHA.7.546 | 2.75 | 2.95 | 0.85 | Not tested | Not tested |
| CHA.7.547 | 2.21 | 1.13 | 26.65 | Not tested | Not tested |
| CHA.7.548 | 3.15 | 3.35 | 4.25 | 1.18 | 1.09 |
| CHA.7.549 | 3.05 | 1.42 | 1.00 | Not tested | Not tested |
| CHA.7.550 | 1.60 | 1.29 | 0.90 | Not tested | Not tested |

Figure 81A

| Antibody (mIgG) | $IC_{50}$ (nM) |
| --- | --- |
| CHA.7.502 | 39.90 |
| CHA.7.503 | No $IC_{50}$ |
| CHA.7.506 | 31.65 |
| CHA.7.508 | 37.88 |
| CHA.7.510 | 55.00 |
| CHA.7.512 | 839.6 |
| CHA.7.514 | 38.88 |
| CHA.7.516 | 33.11 |
| CHA.7.518 | 23.15 |
| CHA.7.520 | 619.3 |
| CHA.7.522 | 50.48 |
| CHA.7.524 | 30.20 |
| CHA.7.525 | 85.52 |
| CHA.7.526 | 58.88 |
| CHA.7.527 | No $IC_{50}$ |
| CHA.7.528 | 28.88 |
| CHA.7.530 | 34.56 |
| CHA.7.534 | 181.4 |
| CHA.7.535 | 821.1 |
| CHA.7.537 | 38.95 |
| CHA.7.538 | 51.87 |
| CHA.7.543 | No $IC_{50}$ |

Figure 81B

| | |
|---|---|
| CHA.7.544 | No IC$_{50}$ |
| CHA.7.545 | 96.06 |
| CHA.7.546 | 92.05 |
| CHA.7.547 | 27.94 |
| CHA.7.548 | 18.98 |
| CHA.7.549 | 36.12 |
| CHA.7.550 | 58.34 |

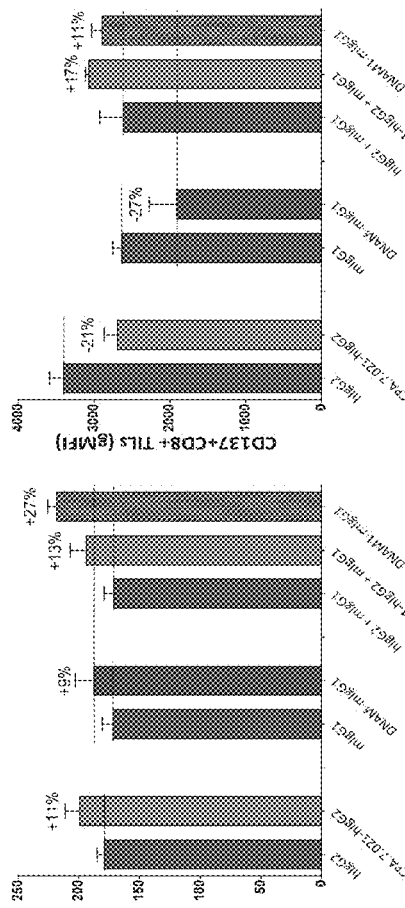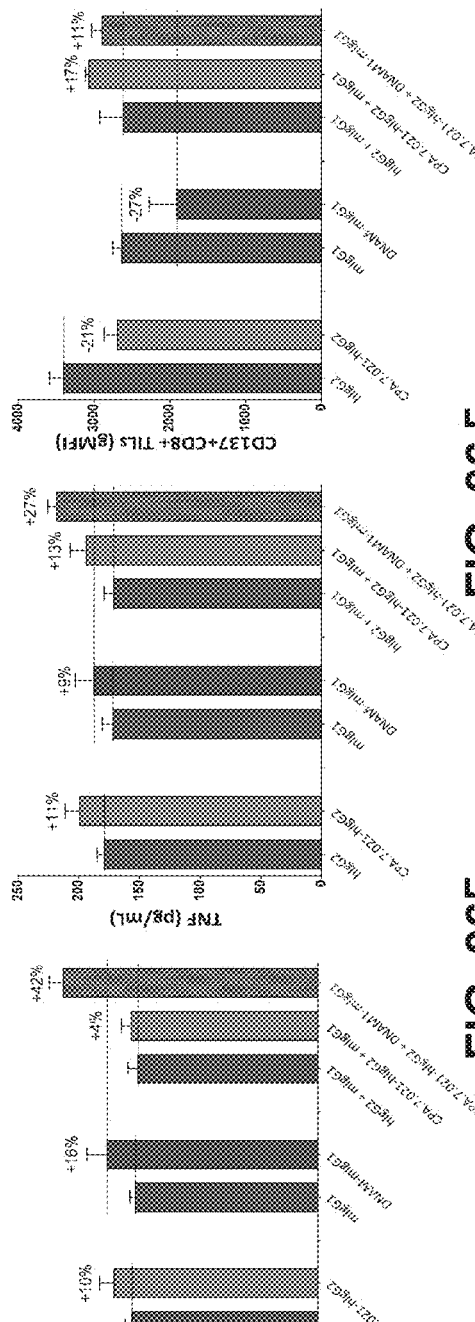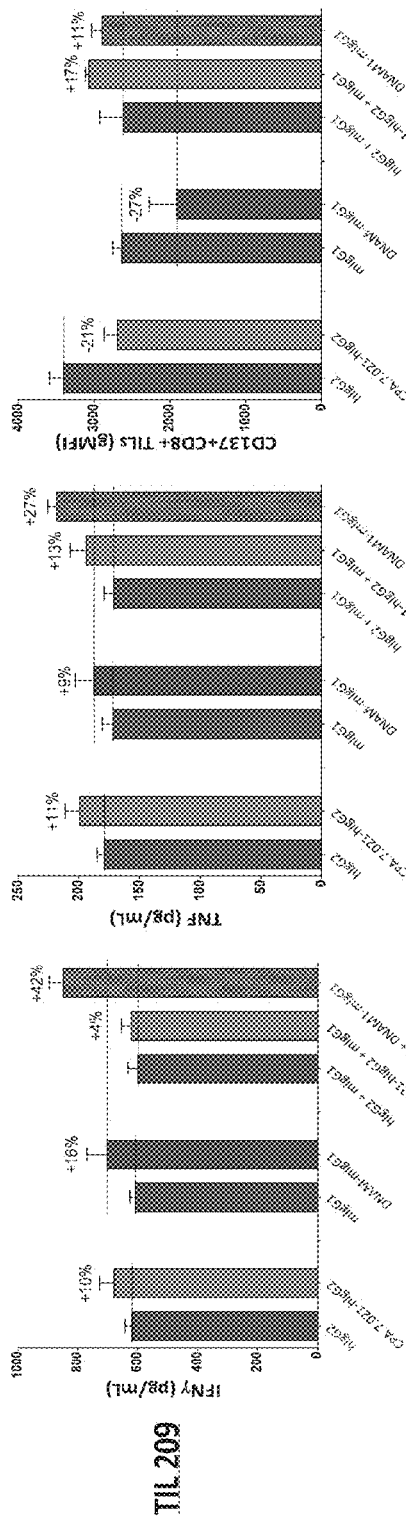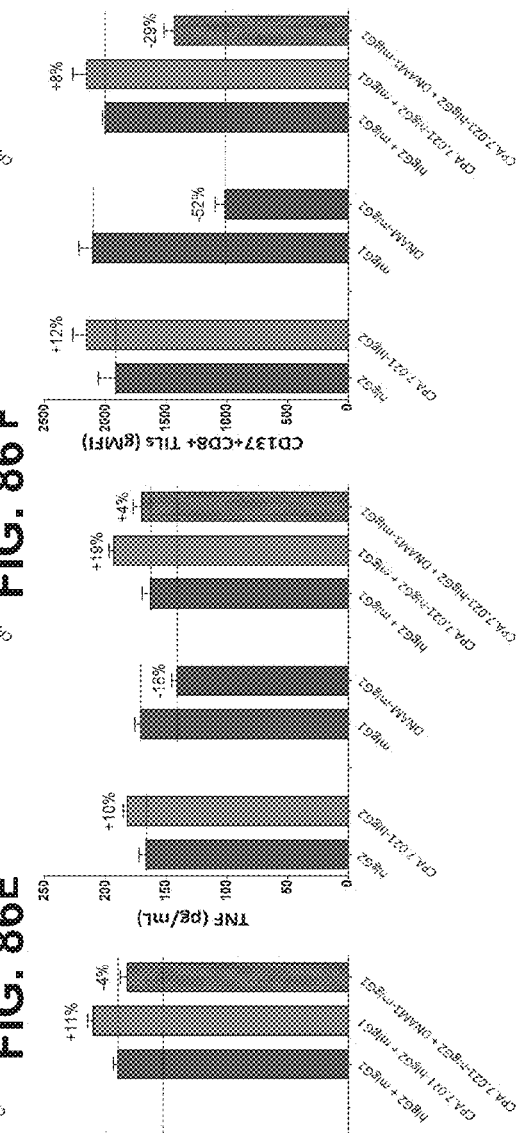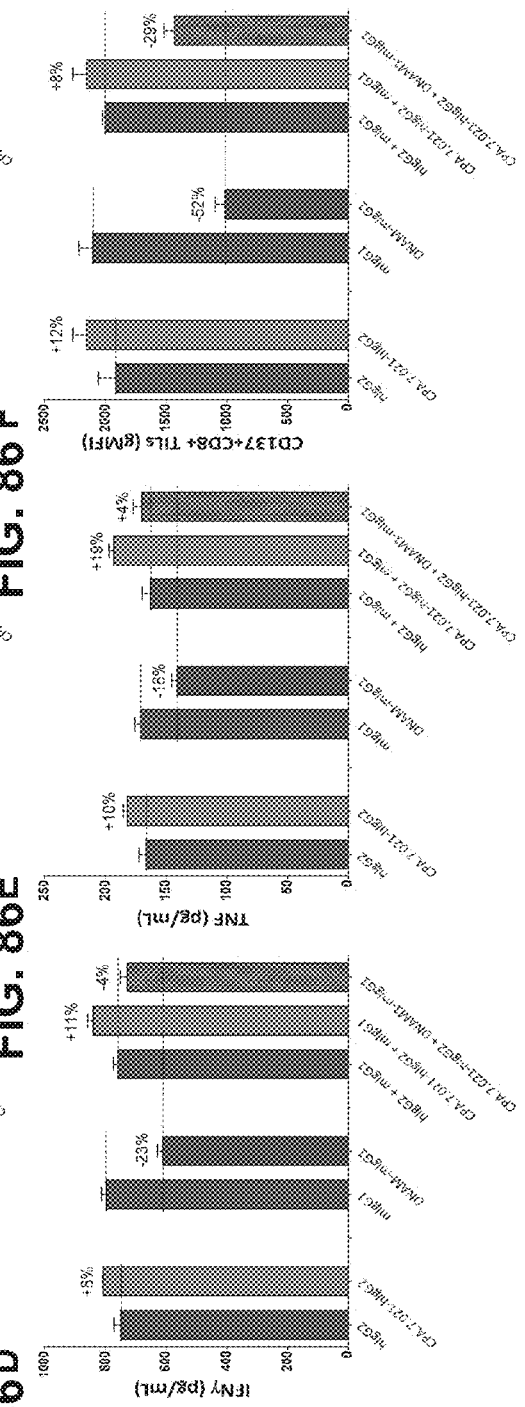

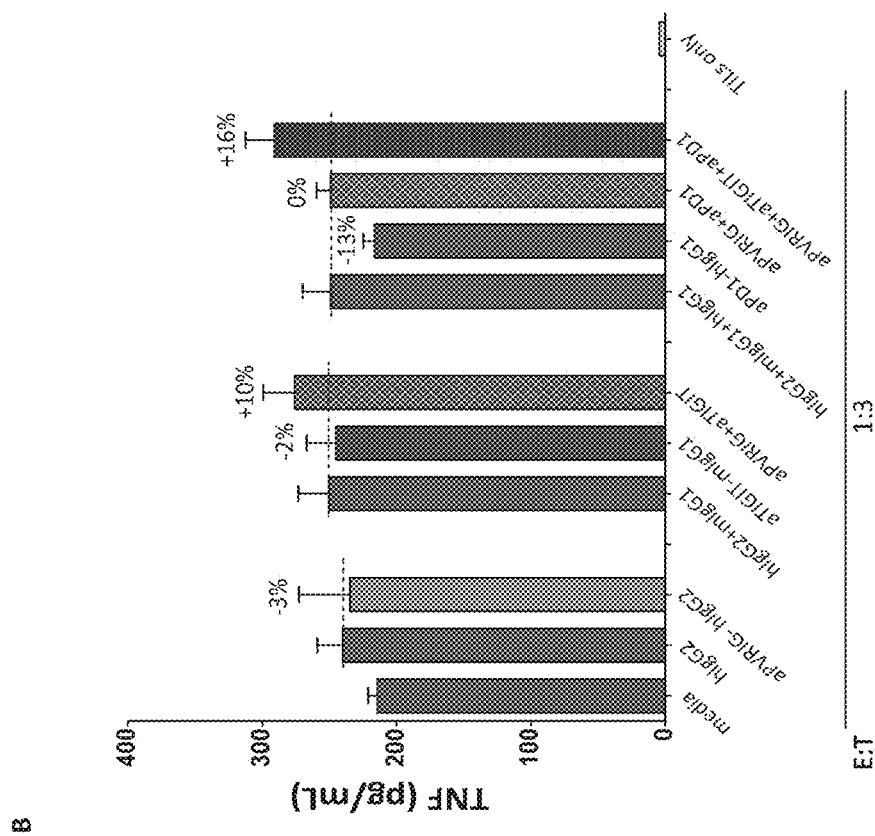
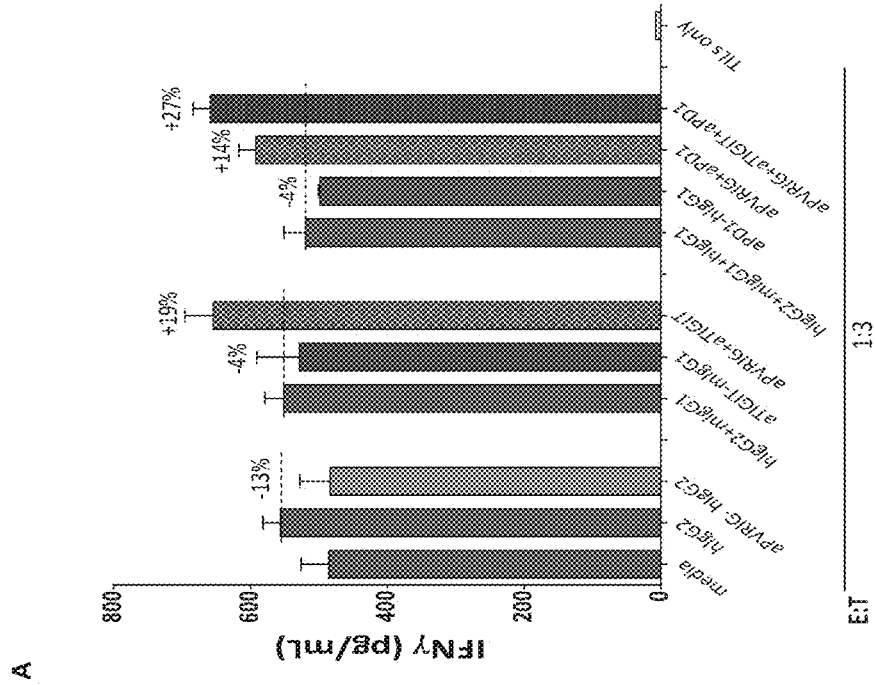
FIGURE 87A
FIGURE 87B

Figure 88A
Humanized sequences of CHA.7.518 antibody VH

Potential humanized sequence based on IMGT IGHV1-46*01 acceptor framework (AbM CDR definition)

```
IGHV1-46*01  QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
(SEQ ID NO: 1368)

Joining region  IMGT J00256|IGHJ4*01|YFDYWGQGTLVTVSS (SEQ ID NO: 1369)

10         20         30         40         50         60         70         80         90
seq                 10         20         30         40         50         60         70         80    abc     90
AbM       b b b   b        p b b b        b b b    b       b  b  b    bi i    i ibb  b         a        i b   b b b b x    **** **** ****       * *    b b b  b        bibibb
518       EVQLQQSGPELVKPGASVKISCKAS  GYTFTSYYMH  WVKQSHGKSLEWIG  YIYPYIGGSG  YNQKFKSKATLSADNPSSTAYMELRSLTSEDSAVYYCAR
           *   ***     *                *                *        ****                *

1-46*01   QVQLVQSGAEVKKPGASVKVSCKAS  GYTFTSYYMH    WVRQAPGQGLEW**G  IINPSGGSTS  YAQKFQGRVTMTRDTSTSTVYMELSSLRSEDTAVYYCAR
h518H1    QVQLVQSGAEVKKPGASVKVSCKAS  GYTFTDYNIN    WVRQAPGQGLEWMG   YIYPYIGGSG  YAQKFQGRVTMTRDTSTSTVYMELSSLRSEDTAVYYCAR
h518H2    QVQLVQSGAEVKKPGASVKVSCKAS  GYTFTDYNIN    WVRQAPGQGLEWIG   YIYPYIGGSG  YAQKFQGRVTMTRDTSTSTVVMELSSLRSEDTAVYYCAR
h518H3    QVQLVQSGAEVKKPGASVKISCKAS  GYTFTDYNIN    WVRQAPGQGLEWIG   YIYPYIGGSG  YAQKFQGRATLTADTSTSTAYMELSSLRSEDTAVYYCAR
h518H4    QVQLVQSGAEVKKPGASVKISCKAS  GYTFTDYNIN    WVRQAPGQGLEWIG   YIYPYIGGSG  YAQKFQGRATLTADNSTSTAYMELSSLRSEDTAVYYCAR
                V                           #                                              N 100        110        120
seq                        110
AbM                i   b b b
518        EDKTARNAMDY  WGQGTPVTVSS  (SEQ ID NO: 1370)
                  *                  (1-46*01 disclosed as SEQ ID NO: 1371)
h518H1     EDKTARNAMDY  WGQGTLVTVSS  (SEQ ID NO: 1372)
h518H2     EDKTARNAMDY  WGQGTLVTVSS  (SEQ ID NO: 1373)
h518H3     EDKTARNAMDY  WGQGTLVTVSS  (SEQ ID NO: 1374)
h518H4     EDKTARNAMDY  WGQGTLVTVSS  (SEQ ID NO: 1375)
                #
``` deamidation substitutions: Q/S/A

Figure 88B
Humanized sequences of CHA.7.518 antibody VL

Potential humanized sequence based on IMGT IGKV1-39*01 acceptor framework

IGKV1*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO: 1376)

Joining region IMGT J00242|IGKJ2*01|YTFGQGTKLEIK (SEQ ID NO: 1377)

```
                        10         20         30         40         50         60         70         80
                        10         20         30         40         50         60         70         80
seq            b b b    p p    p p b b b    b b  bi bi ii ibbi        i          b   b  b b b  ib bib
AbM
518            DIQMTQSPASLSVSVGETVTIC RVSENIYSNLA WYQQKGGKSPQLIVY EAINLAE GVPSRFSGSGSGTQYSLKINSLQSEDFGSYYC
                        * *                *        *  *                #                       ***  *  *      **

IGKV1-39       DIQMTQSPSSLSASVGDRVTITC RASQSISSYLN WYQQKPGKAPKLLIY AASSLQS GVPSRFSGSGSGTDFTLTISSLQPEDFATYYC
h518L1         DIQMTQSPSSLSASVGDRVTITC RVSENIYSNLA WYQQKPGKAPKLLIY EAINLAE GVPSRFSGSGSGTDFTLTISSLQPEDFATYYC
h518L2         DIQMTQSPSSLSASVGDRVTITC RVSENIYSNLA WYQQKPGKAPKLLIY EAINLAE GVPSRFSGSGSGTDYTLTISSLQPEDFATYYC
h518L3         DIQMTQSPSSLSASVGDRVTITC RVSENIYSNLA WYQQKPGKAPKLLIVY EAINLAE GVPSRFSGSGSGTDVTLTISSLQPEDFATYYC
                        V                                           S                              #

90        100
                        90        100
seq            ibi  iib  i  b b b
AbM
518            QHFWGTPYT FGGGTKLEIK (SEQ ID NO: 1378)
                        *

IGKV1-39       QQSYSTPP (SEQ ID NO: 1379)
h518L1         QHFWGTPYT FGQGTKLEIK (SEQ ID NO: 1380)
h518L2         QHFWGTPYT FGQGTKLEIK (SEQ ID NO: 1381)
h518L3         QHFWGTPYT FGQGTKLEIK (SEQ ID NO: 1382)
                        @
``` deamidation substitutions: Q/S/A/D
@ tryptophan oxidation substitutions: Y/F/H Figure 88C
Humanized sequences of CHA.7.524 antibody VH Potential humanized sequence based on IMGT IGHV1-46*01 acceptor framework.
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO: 1383)
Joining region    IMGT J00256|IGHJ4*01|YFDYWGQGTLVTVSS (SEQ ID NO: 1384)

```
seq              10         20         30         40         50         60         70         80         90
AbM              10         20         30         40         50  a      60         70         80  abc    90
                 b b b      p b b b    b b      b b i i  i bb b     i bb b     i  b  b bb b x      b b b   b  bibibb
524         QVQLQQSGPEVVRPGVSVKISCKGS GYKFPDYVMH WVKQSHAKSLEWIG IISIYSGNTN YNQKFKGKATMTVDKSSSTAYMELARLTSEDSAIYYCAR
                *          *          *******    *              *            *    *    **  *          **  *    *   *

1-46*01     QVQLVQSGAEVKKPGASVKVSCKAS GYTFTSYYMH WVRQAPGQGLEWMG IINPSGGSTS YAQKFQGRVTMTRDTSTSTVYMELSSLRSEDTAVYYCAR
h524H1      QVQLVQSGAEVKKPGASVKVSCKAS GYKFPDYVMH WVRQAPGQGLEWIG IISIYSGNTN YAQKFQGRVTMTRDTSTSTVYMELSSLRSEDTAVYYCAR
h524H2      QVQLVQSGAEVKKPGASVKVSCKAS GYKFPDYVMH WVRQAPGQGLEWIG IISIYSGNTN YAQKFQGRVTMTVDTSTSTVYMELSSLRSEDTAVYYCAR
h524H3      QVQLVQSGAEVKKPGASVKISCKGS GYKFPDYVMH WVRQAPGQGLEWIG IISIYSGNTN YAQKFQGRATMTVDTSTSTAYMELSSLRSEDTAVYYCAR
h524H4      QVQLVQSGAEVKKPGASVKISCKGS GYKFPDYVMH WVRQAPGQGLEWIG IISIYSGNTN YAQKFQGRATMTVDKSTSTAYMELSSLRSEDTAVYYCAR
                 V                                                              #  #      N                             I seq             100        110
AbM             100        110
                            i  b b b
524         EGDLPMFAY WGQGTLVTVSA (SEQ ID NO: 1385)
                *          (1-46*01 disclosed as SEQ ID NO: 1386)
h524H1      EGDLPMFAY WGQGTLVTVSS (SEQ ID NO: 1387)
h524H2      EGDLPMFAY WGQGTLVTVSS (SEQ ID NO: 1388)
h524H3      EGDLPMFAY WGQGTLVTVSS (SEQ ID NO: 1389)
h524H4      EGDLPMFAY WGQGTLVTVSS (SEQ ID NO: 1390)
                @
```

\# deamidation substitutions: Q/S/A
@ methionine oxidation substitutions: L/F/A

Figure 88D
humanized sequences of CHA.7.524 antibody VL

Potential humanized sequence based on IMGT IGKV3-11*01 acceptor framework.
IGKV3-11*01
EIVLTQSPATLSLSPGERATLSCRASQSVSSYLAWYQQKPGQAPRLLIYDASNRATGIPARFSGSGSGTDFTLTISSLEPEDFAVYYCQQRSNWPP (SEQ ID NO: 1391)
Joining region IMGT J00242|IGKJ2*01|YTFGQGTKLEIK (SEQ ID NO: 1392)

```
                        10         20         30         40         50         60         70         80
                        10         20         30         40         50         60         70         80
seq
AbM              b b b     p p   b b b        b  bi bi i   ii ibbi  i      b  b           b b b  h       ib bib
524              QIVLTQSPAIMSASPGEKVTMTC NASSSVS-YMY WYQQKPISSPRLLIY DTSNLAS GVPVRFSGSGSGTSYSLTIGRMEAEDAATYYC
                 *                *** *                ***                  *   *   ***  *       *
                                  M A                                                              S IGKV3-11         EIVLTQSPATLSLSPGERATLSC RASQSVSSYLA WYQQKPGQAPRLLIY DASNRAT GIPARFSGSGSGTDFTLTISSLEPEDFAVYYC
h524L1           EIVLTQSPATLSLSPGERATLSC NASSSVS-YMY WYQQKPGQAPRLLIY DTSNLAS GIPARFSGSGSGTDFTLTISSLEPEDFAVYYC
h524L2           EIVLTQSPATLSLSPGERATLSC NASSSVS-YMY WYQQKPGQAPRLLIY DTSNLAS GIPARFSGSGSGTDYTLTISSLEPEDFAVYYC
h524L3           EIVLTQSPATLSLSPGERVT&SC NASSSVS-YMY WYQQKPGQAPRLLIY DTSNLAS GVPARFSGSGSGTDYTLTISSMEPEDFAVYYC
                                      #                                                                   A 90        100
                        90        100
seq
AbM              ibi iib i    b b b
524              QQRSNWPP FGAGTKVEVK (SEQ ID NO: 1393)
                 @                *

IGKV3-11         QQRSNWPP (SEQ ID NO: 1394)
h524L1           QQWSSYPLT FGQGTKLEIK (SEQ ID NO: 1395)
h524L2           QQWSSYPLT FGQGTKLEIK (SEQ ID NO: 1396)
h524L3           QQWSSYPLT FGQGTKVEIK (SEQ ID NO: 1397)
                                   V
```

\# deamidation substitutions: Q/S/A/D
@ tryptophan oxidation substitutions: Y/F/H Figure 88E
Humanized sequences of CHA.7.530 antibody VH Potential humanized sequence based on IMGT IGHV1-46*01 acceptor framework
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO: 1398)
Joining region    IMGT J00256|IGHJ4*01|YFDYWGQGTLVTVSS (SEQ ID NO: 1399)

```
seq              10         20         30         40         50         60         70         80         90
AbM              10         20         30         40         50    a    60         70    b b b z    80  abc   90
                 b b b      p b b b    b b   b   b b i    i ibb b       i b        b b b z         b b b     bibibb
530              QVQLQQSGAELMRPGTSVKVSCKAS GYAFTNHLIE WIKQRPGQGLEWIG VINPGSDSTD YNEKFKDKATLTADKSSSTAYMQLSSLTSDDSAVYFCAR
                 *              ***                           *       *    **       *        ***  *          *  *  *
1-46*01          QVQLVQSGAEVKKPGASVKVSCKAS GYTFTSYYMH WVRQAPGQGLEWMG IINPSGGSTS YAQKFQGRVTMTRDTSTSTVYMELSSLRSEDTAVYYCAR
h530H1           QVQLVQSGAEVKKPGASVKVSCKAS GYAFTNHLIE WVRQAPGQGLEWMG VINPGSDSTD YAQKFQGRVTMTRDTSTSTVYMELSSLRSEDTAVYYCAR
h530H2           QVQLVQSGAEVKKPGASVKVSCKAS GYAFTNHLIE WVRQAPGQGLEWIG VINPGSDSTD YAQKFQGRVTMTADTSTSTVYMELSSLRSEDTAVYYCAR
h530H3           QVQLVQSGAEVKKPGASVKVSCKAS GYAFTNHLIE WIRQAPGQGLEWIG VINPGSDSTD YAQKFQGRATLTADTSTSTAYMELSSLRSEDTAVYYCAR
h530H4           QVQLVQSGAEVKKPGASVKVSCKAS GYAFTNHLIE WIRQAPGQGLEWIG VINPGSDSTD YAQKFQGRATLTADKSTSTAYMELSSLRSEDTAVYYCAR
                 M                                                    #            N                                F seq              100        110
AbM                    i    b b b
530              SLYYNSWFVY WGQGTLVTVSA (SEQ ID NO: 1400)
                        *              (1-46*01 disclosed as SEQ ID NO: 1401)
h530H1           SLYYNSWFVY WGQGTLVTVSS (SEQ ID NO: 1402)
h530H2           SLYYNSWFVY WGQGTLVTVSS (SEQ ID NO: 1403)
h530H3           SLYYNSWFVY WGQGTLVTVSS (SEQ ID NO: 1404)
h530H4           SLYYNSWFVY WGQGTLVTVSS (SEQ ID NO: 1405)
                   #  @
```

\# deamidation substitutions: Q/S/A
@ tryptophan oxidation substitutions: Y/F/H

Figure 88F
Humanized sequences of CHA.7.530 antibody VL

Potential humanized sequence based on IMGT IGKV1-39*01 acceptor framework (AbM CDR definition)
IGKV1-39*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO: 1406)
Joining region IMGT J00242|IGKJ2*01|YTFGQGTKLEIK (SEQ ID NO: 1407)

```
                 10         20         30         40         50         60         70         80
                 10         20         30         40         50         60         70         80
seq           b  b   b    p p   p b b   b    b   bi bi   i    ii ibbi    i       b  b   b  b  b   ib bib
AbM                  *                  *  *                        *                *            *  *
530           DIQMTQSPASLSASVGETVTITC RASENIYSYLA WYQQKRGKSPQLLVY NAKTLVE GVPSRFSGSGSGTQFSLKINSLQPEDFGSYYC IGKV1-39      DIQMTQSPSSLSASVGDRVTITC RASQSISSYLN WYQQKPGKAPKLLIY AASSLQS GVPSRFSGSGSGTDFTLTISSLQPEDFATYYC
h530L1        DIQMTQSPSSLSASVGDRVTITC RASENIYSYLA WYQQKPGKAPKLLIY NAKTLVE GVPSRFSGSGSGTDFTLTISSLQPEDFATYYC
h530L2        DIQMTQSPSSLSASVGDRVTITC RASENIYSYLA WYQQKPGKAPKLLIY NAKTLVE GVPSRFSGSGSGTDFTLTISSLQPEDFATYYC
                                           #                           S      #

90        100
                 90        100
seq           ibi iib   i     b b
AbM                  *
530           QHHYGTPYT FGGGTKLEIK (SEQ ID NO: 1408)

IGKV1-39      QQSYSTPP  (SEQ ID NO: 1409)
h530L1        QHHYGTPYT FGQGTKLEIK (SEQ ID NO: 1410)
h530L2        QHHYGTPYT FGQGTKLEIK (SEQ ID NO: 1411)
```

\# deamidation substitutions: Q/S/A/D

Figure 88G
Humanized sequences of CHA.7.538_1 antibody VH

Potential humanized sequence based on IMGT IGHV1-46*01 acceptor framework
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO: 1412)
Joining region  IMGT J00256|IGHJ4*01|YFDYWGQGTLVTVSS (SEQ ID NO: 1413)

```
seq                       10         20         30         40         50         60         70         80         90
AbM                       10         10         20         30         40         50         60         70         80    abc      90
           b b b       p      b b b b            b b       b   b i i    i ibb   b           i  b  b b x    *  * *   b b b  b     bibibb
538_1    QVQLQQSGAELVRPGASVKVSCKAS GYTFTSYYMH WVKQRPGQGLEWIG IINPSGGSTS YNDKFKVKTTLTADKSSTAYMQLSSLTSDDSAVYFCAR
           *  *                 ***                  *               *    #  a     **** **   *  * *    * *     *   *       F
                                                                                                                              T
1-46*01  QVQLVQSGAEVKKPGASVKVSCKAS GYTFTSYYMH WVRQAPGQGLEWMG IINPSGGSTS YAQKFQGRVTMTRDTSTSTVYMELSSLRSEDTAVYYCAR
h5381H1  QVQLVQSGAEVKKPGASVKVSCKAS GYAFTNYLIE WVRQAPGQGLEWMG VINPGSGGIY YAQKFQGRVTMTRDTSTSTVYMELSSLRSEDTAVYYCAR
h5381H2  QVQLVQSGAEVKKPGASVKVSCKAS GYAFTNYLIE WVRQAPGQGLEWIG VINPGSGGIY YAQKFQGRVTMADTSTSTVYMELSSLRSEDTAVYYCAR
h5381H3  QVQLVQSGAEVKKPGASVKVSCKTS GYAFTNYLIE WVRQAPGQGLEWIG VINPGSGGIY YAQKFQGRVTKTTADTSTSTAYMELSSLRSEDTAVYYCAR
h5381H4  QVQLVQSGAEVKKPGASVKVSCKTS GYAFTNYLIE WVRQAPGQGLEWIG VINPGSGGIY YAQKFQGRVTLTADXSTSTAYMELSSLRSEDTAVYYCAR
                                                                           N  T seq       100        110
AbM                  110
                  i    b b b
538_1    SETHDTWFAY WGQGTLVTVSA (SEQ ID NO: 1414)
              @          *     (1-46*01 disclosed as SEQ ID NO: 1415)
h5381H1  SETHDTWFAY WGQGTLVTVSS (SEQ ID NO: 1416)
h5381H2  SETHDTWFAY WGQGTLVTVSS (SEQ ID NO: 1417)
h5381H3  SETHDTWFAY WGQGTLVTVSS (SEQ ID NO: 1418)
h5381H4  SETHDTWFAY WGQGTLVTVSS (SEQ ID NO: 1419)
```

\# deamidation substitutions: Q/S/A
@ tryptophan oxidation substitutions: Y/F/H

Figure 88H
humanized sequences of CHA.7.538_1 antibody VL

Potential humanized sequence based on IMGT IGKV1-39*01 acceptor framework.
IGKV1-39*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO: 1420)

Joining region IMGT J00242|IGKJ2*01|YTFGQGTKLEIK (SEQ ID NO: 1421)

IGKV1-17*02
DIQMTQSPSSLSASVGDRVTITCRASQGIRNDLGWYQQKPGKAPKRLLIYAASSLQSGVPSRFSGSGSGTEFTLTISNLQPEDFATYCLQHNSYPP (SEQ ID NO: 1422)

```
                10         20         30         40         50         60         70         80
seq             10         20         30         40         50         60         70         80
AbM     b b b   p p   p p b b   b   b i b b   b i b i   i i b b i     b b         b b b   i b b i b
538     DIVMTQSQKFISTSVGDRVSITC KASQSVRIAVA WFQQKPGQSPKALIY LASTRHT i GVPDRFTGSGSGTDFTLTISNVQSEDLADYFC
         *               *  *             * *              **      *       *                      *  *  *
IGKV1-39 DIQMTQSPSSLSASVGDRVTITC RASQSISSYLN WYQQKPGKAPKLLIY AASSLQS   GVPSRFSGSGSGTDFTLTISSLQPEDFATYYC
h538L1   DIQMTQSPSSLSASVGDRVTITC KASQSVRIAVA WYQQKPGKAPKLLIY LASTRHT   GVPSRFSGSGSGTDFTLTISSLQPEDFATYYC
h538L2   DIQMTQSPSSLSASVGDRVTITC KASQSVRIAVA WFQQKPGKAPKLLIY LASTRHT   GVPSRFSGSGSGTDFTLTISVQPEDFATYYC
                I T                           S                                              L  F 90        100
seq             90        100
AbM     i b i   i i b   i   b b b
538     LQHWNYPYT FGGGTKLEIK (SEQ ID NO: 1423)
          @#            *
IGKV1-39 QQSYSTPP (SEQ ID NO: 1424)
h538L1   LQHWNYPYT FGQGTKLEIK (SEQ ID NO: 1425)
h538L2   LQHWNYPYT FGQGTKLEIK (SEQ ID NO: 1426)
```

\# deamidation substitutions: Q/S/A/D
@ tryptophan oxidation substitutions: Y/F/H Figure 88I
humanized sequences of CHA.7.538_2 antibody VH Potential humanized sequence based on IMGT IGHV1-46*01 acceptor framework
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO: 1427)
Joining region
IMGT J00256|IGHJ4*01|YFDYWGQGTLVTVSS (SEQ ID NO: 1428)

```
seq              10         20         30         40         50  a      60         70         80  abc   90
AbM              10         20         30         40         50         60         70         80         90
         b b b   p         p b b b   b b       b b i     i ibb b          i  b b b b x       b b b b   bibibb
538_2    QVQLQQSGAELVRPGTSVKMSCKAA GYTFTNYWIG DIYPGGGYTN YNEKFKGKATLTADTSSTAYMQLSSLTSEDSAIYYCAS
              *    *      * ***      *          *   #           **   * * **    *           **     *

1-46*01  QVQLVQSGAEVKKPGASVKVSCKAS GYTFTSYYMH WVRQAPGQGLEWMG IINPSGGSTS YAQKFQGRVTMTRDTSTSTVYMELSSLRSEDTAVYYCAR
h5382H1  QVQLVQSGAEVKKPGASVKVSCKAS GYTFTNYWIG WVRQAPGQGLEWMG DIYPGGGYTN YAQKFQGRVTMTRDTSTSTVYMELSSLRSEDTAVYYCAR
h5382H2  QVQLVQSGAEVKKPGASVKVSCKAS GYTFTNYWIG WVRQAPGQGLEWIG DIYPGGGYTN YAQKFQGRVTMTRDTSTSTVYMELSSLRSEDTAVYYCAR
h5382H3  QVQLVQSGAEVKMSCKAS        GYTFTNYWIG WVRQAPGQGLEWIG DIYPGGGYTN YAQKFQGRATLTADTSTSTAYMELSSLRSEDTAVYYCAS
                V                                  #  @                        # N                            i seq       100        110
AbM                  110
                   i  b b b
538_2    PYYGSSYGFAF WGQGTLVTVSA (SEQ ID NO: 1429)
                     *         (1-46*01 disclosed as SEQ ID NO: 1430)
h5382H1  PYYGSSYGFAF WGQGTLVTVSS (SEQ ID NO: 1431)
h5382H2  PYYGSSYGFAF WGQGTLVTVSS (SEQ ID NO: 1432)
h5382H3  PYYGSSYGFAF WGQGTLVTVSS (SEQ ID NO: 1433)
```

\# deamidation substitutions: Q/S/A
@ tryptophan oxidation substitutions: Y/F/H

Figure 89A humanized CHA.7.518 VH h518HH1
QVQLVQSGAEVKKPGASVKVSCKASGYTFTDYNINWVRQAPGQGLEWMGYIYPYIGGSGYAQKFQGRVTMTRDTSTSTVY
MELSSLRSEDTAVYYCAREDKTARNAMDYWGQGTLVTVSS (SEQ ID NO: 1434)

h518HH2
QVQLVQSGAEVKKPGASVKVSCKASGYTFTDYNINWVRQAPGQGLEWIGYIYPYIGGSGYAQKFQGRVTMTADTSTSTVY
MELSSLRSEDTAVYYCAREDKTARNAMDYWGQGTLVTVSS (SEQ ID NO: 1435)

h518HH3
QVQLVQSGAEVKKPGASVKISCKASGYTFTDYNINWVRQAPGQGLEWIGYIYPYIGGSGYAQKFQGRATLTADTSTSTAYM
ELSSLRSEDTAVYYCAREDKTARNAMDYWGQGTLVTVSS (SEQ ID NO: 1436)

h518HH4
QVQLVQSGAEVKKPGASVKISCKASGYTFTDYNINWVRQAPGQGLEWIGYIYPYIGGSGYAQKFQGRATLTADNSTSTAYM
ELSSLRSEDTAVYYCAREDKTARNAMDYWGQGTLVTVSS (SEQ ID NO: 1437)

humanized CHA.7.524 VH h524HH1
QVQLVQSGAEVKKPGASVKVSCKASGYKFPDYVMHWVRQAPGQGLEWMGIISIYSGNTNYAQKFQGRVTMTRDTSTSTV
YMELSSLRSEDTAVYYCAREGDLPMFAYWGQGTLVTVSS (SEQ ID NO: 1438)

h524HH2
QVQLVQSGAEVKKPGASVKVSCKASGYKFPDYVMHWVRQAPGQGLEWIGIISIYSGNTNYAQKFQGRVTMTVDTSTSTVVY
MELSSLRSEDTAVYYCAREGDLPMFAYWGQGTLVTVSS (SEQ ID NO: 1439)

h524HH3
QVQLVQSGAEVKKPGASVKISCKGSGYKFPDYVMHWVRQAPGQGLEWIGIISIYSGNTNYAQKFQGRATMTVDTSTSTAY
MELSSLRSEDTAVYYCAREGDLPMFAYWGQGTLVTVSS (SEQ ID NO: 1440)

Figure 89B
h524HH4
QVQLVQSGAEVKKPGASVKISCKGSGYKFPDYVMHWVRQAPGQGLEWIGHSIYSGNTNYAQKFQGRATMTVDKSTSTAY
MELSSLRSEDTAVYYCAREGDLPMFAYWGQGTLVTVSS (SEQ ID NO: 1441)

humanized CHA.7.530 VH
h530HH1
QVQLVQSGAEVKKPGASVKVSCKASGYAFTNHLIEWVRQAPGQGLEWMGVINPGSDSTDYAQKFQGRVTMTRDTSTSTVY
MELSSLRSEDTAVYYCARSLYYNSWFVYWGQGTLVTVSS (SEQ ID NO: 1442)

h530HH2
QVQLVQSGAEVKKPGASVKVSCKASGYAFTNHLIEWVRQAPGQGLEWIGVINPGSDSTDYAQKFQGRVTMTADTSTSTVY
MELSSLRSEDTAVYYCARSLYYNSWFVYWGQGTLVTVSS (SEQ ID NO: 1443)

h530HH3
QVQLVQSGAEVKKPGASVKVSCKASGYAFTNHLIEWIRQAPGQGLEWIGVINPGSDSTDYAQKFQGRATLTADTSTSTAYM
ELSSLRSEDTAVYYCARSLYYNSWFVYWGQGTLVTVSS (SEQ ID NO: 1444)

h530HH4
QVQLVQSGAEVKKPGASVKVSCKASGYAFTNHLIEWIRQAPGQGLEWIGVINPGSDSTDYAQKFQGRATLTADKSTSTAYM
ELSSLRSEDTAVYYCARSLYYNSWFVYWGQGTLVTVSS (SEQ ID NO: 1445)

humanized CHA.7.538_1 VH
h5381HH1
QVQLVQSGAEVKKPGASVKVSCKASGYAFTNYLIEWVRQAPGQGLEWMGVINPGSGGIYYAQKFQGRVTMTRDTSTSTVY
MELSSLRSEDTAVYYCARSETHDTWFAYWGQGTLVTVSS (SEQ ID NO: 1446)

h5381HH2
QVQLVQSGAEVKKPGASVKVSCKASGYAFTNYLIEWVRQAPGQGLEWIGVINPGSGGIYYAQKFQGRVTMTADTSTSTVY
MELSSLRSEDTAVYYCARSETHDTWFAYWGQGTLVTVSS (SEQ ID NO: 1447)

Figure 89C
h5381HH3
QVQLVQSGAEVKKPGASVKVSCKTSGYAFTNYLIEWVRQAPGQGLEWIGVINPGSGGIYAQKFQGRVTLTADTSTSTAYM
ELSSLRSEDTAVYYCARSETHDTWFAYWGQGTLVTVSS (SEQ ID NO: 1448)

h5381HH4
QVQLVQSGAEVKKPGASVKVSCKTSGYAFTNYLIEWVRQAPGQGLEWIGVINPGSGGIYAQKFQGRVTLTADKSTSTAYM
ELSSLRSEDTAVYYCARSETHDTWFAYWGQGTLVTVSS (SEQ ID NO: 1449)

humanized CHA.7.538_2 VH
h5382HH1
QVQLVQSGAEVKKPGASVKVSCKASGYTFTNYWIGWVRQAPGQGLEWMGDIYPGGGYTNYAQKFQGRVTMTRDTSTSTV
YMELSSLRSEDTAVYYCARPYYGSSYGFAFWGQGTLVTVSS (SEQ ID NO: 1450)

h5382HH2
QVQLVQSGAEVKKPGASVKVSCKASGYTFTNYWIGWVRQAPGQGLEWIGDIYPGGGYTNYAQKFQGRVTMTADTSTSTV
YMELSSLRSEDTAVYYCASPYYGSSYGFAFWGQGTLVTVSS (SEQ ID NO: 1451)

h5382HH3
QVQLVQSGAEVKKPGASVKMSCKASGYTFTNYWIGWVRQAPGQGLEWIGDIYPGGGYTNYAQKFQGRATLTADTSTSTA
YMELSSLRSEDTAVYYCASPYYGSSYGFAFWGQGTLVTVSS (SEQ ID NO: 1452)

humanized CHA.7.518 VL
h518HL1
DIQMTQSPSSLSASVGDRVTITCRVSENIYSNLAWYQQKPGKAPKLLIYEATNLAEGVPSRFSGSGSGTDFTLTISSLQPEDFA
TYYCQHFWGTPYTFGQGTKLEIK (SEQ ID NO: 1453)

h518HL2
DIQMTQSPSSLSASVGDRVTITCRVSENIYSNLAWYQQKPGKAPKLLIYEATNLAEGVPSRFSGSGSGIDYLTISSLQPEDFA
TYYCQHFWGTPYTFGQGTKLEIK (SEQ ID NO: 1454)

Figure 89D
h518HL3
DIQMTQSPSSLSASVGDRVTITCRVSENIYSNLAWYQQKPGKAPKLLVYEATNLAEGVPSRFSGSGSGTDYTLTISSLQPEDF
GTYYCQHFWGTPYTFGQGTKLEIK (SEQ ID NO: 1455)

humanized CHA.7.524 VL
h524HL1
EIVLTQSPATLSLSPGERATLSCNASSSVSYMYWYQQKPGQAPRLLIYDTSNLASGIPARFSGSGSGTDFTLTISSLEPEDFAVY
YCQQWSSYPLTFGQGTKLEIK (SEQ ID NO: 1456)

h524HL2
EIVLTQSPATLSLSPGERATLSCNASSSVSYMYWYQQKPGQAPRLLIYDTSNLASGIPARFSGSGSGTDYTLTISSLEPEDFAVY
YCQQWSSYPLTFGQGTKLEIK (SEQ ID NO: 1457)

h524HL2
EIVLTQSPATLSLSPGERVTMSCNASSSVSYMYWYQQKPGQAPRLLIYDTSNLASGVPARFSGSGSGTDYTLTISSMEPEDFA
VYYCQQWSSYPLTFGQGTKVEIK (SEQ ID NO: 1458)

humanized CHA.7.530 VL
h530HL1
DIQMTQSPSSLSASVGDRVTITCRASENIYSYLAWYQQKPGKAPKLLIYNAKTLVEGVPSRFSGSGSGTDFTLTISSLQPEDFA
TYYCQHHYGTPYTFGQGTKLEIK (SEQ ID NO: 1459)

h530HL2
DIQMTQSPSSLSASVGDRVTITCRASENIYSYLAWYQQKPGKAPKLLVYNAKTLVEGVPSRFSGSGSGTDFTLTISSLQPEDFG
TYYCQHHYGTPYTFGQGTKLEIK (SEQ ID NO: 1460)

humanized CHA.7.538_1/538_2 VL
h538HL1
DIQMTQSPSSLSASVGDRVTITCKASQSVRIAVAWYQQKPGKAPKLLIYLASTRHTGVPSRFSGSGSGTDFTLTISSLQPEDFA
TYYCLQHWNYPYTFGQGTKLEIK (SEQ ID NO: 1461)

Figure 89E
h538HL2
DIQMTQSPSSLSASVGDRVTITCKASQSVRIAVAWFQQKPGKAPKALIYLASTRHTGVPSRFSGSGSGTDFTLTISSVQPEDFA
TYYCLQHWNYPYTFGQGTKLEIK (SEQ ID NO: 1462)

Figure 90: humanized CHA.7 VH-VL Pairs
Antibody CHA.7.518

|  | VH | VL |
|---|---|---|
| ch518 | chimVH | chimVL |
| h518-1 | h518HH1 | h518HL1 (optional) |
| h518-2 | h518HH2 | h518HL2 |
| h518-3 | h518HH3 | h518HL2 |
| h518-4 | h518HH3 | h518HL3 |
| h518-5 | h518HH4 | h518HL3 |

Antibody CHA.7.524

|  | VH | VL |
|---|---|---|
| ch524 | chimVH | chimVL |
| h524-1 | h524HH1 | h524HL1 (optional) |
| h524-2 | h524HH2 | h524HL2 |
| h524-3 | h524HH3 | h524HL3 |
| h524-4 | h524HH4 | h524HL3 |

Antibody CHA.7.530

|  | VH | VL |
|---|---|---|
| ch530 | chimVH | chimVL |
| h530-1 | h530HH1 | h530HL1 (optional) |
| h530-2 | h530HH2 | h530HL2 |
| h530-3 | h530HH3 | h530HL1 |
| h530-4 | h530HH3 | h530HL2 |
| h530-5 | h530HH4 | h530HL2 |

Antibody CHA.7.538_1

|  | VH | VL |
|---|---|---|
| ch538.1 | chimVH | chimVL |
| h538.1-1 | h538.1HH1 | h538.1HL1 (optional) |
| h538.1-2 | h538.1HH2 | h538.1HL2 |
| h538.1-3 | h538.1HH3 | h538.1HL2 |
| h538.1-4 | h538.1HH4 | h538.1HL2 |

Antibody CHA.7.538_2

|  | VH | VL |
|---|---|---|
| ch538.2 | chimVH | chimVL |
| h538.2-1 | h538.2HH1 | h538.1HL1 (optional) |
| h538.2-2 | h538.2HH2 | h538.1HL2 |
| h538.2-3 | h538.2HH3 | h538.1HL2 |

Figure 91

| Antibody (mIgG) | Human CD56 int. NK (gMFIr, 10ug/ml) | Human CD8+ T cells (gMFIr, 10ug/ml) | Expl cyno OE/par (gMFIr, 3.3ug/ml) | Cyno NK cells (gMFIr, 10ug/ml) | Cyno CD8+ T cells (gMFIr, 10ug/ml) |
|---|---|---|---|---|---|
| CHA.7.502 | 1.97 | 1.41 | 60.49 | Not tested | Not tested |
| CHA.7.503 | 3.15 | 1.96 | 106.3 | Not tested | Not tested |
| CHA.7.506 | Not tested | Not tested | 0.77 | Not tested | Not tested |
| CHA.7.508 | 3.6 | 4.09 | 41.49 | Not tested | Not tested |
| CHA.7.510 | 3.13 | 2.73 | 38.21 | Not tested | Not tested |
| CHA.7.512 | 1.30 | 1.15 | 8.96 | Not tested | Not tested |
| CHA.7.514 | 4.16 | 5.15 | 65.20 | Not tested | Not tested |
| CHA.7.516 | 4.22 | 4.09 | 60.05 | 1.76 | 2.09 |
| CHA.7.518 | 5.08 | 6.69 | 83.51 | 1.92 | 2.09 |
| CHA.7.520 | 1.13 | 1.04 | Not tested | Not tested | Not tested |
| CHA.7.522 | 2.06 | 1.90 | 27.24 | Not tested | Not tested |
| CHA.7.524 | 5.50 | 6.12 | 66.32 | 1.78 | 2.02 |
| CHA.7.525 | 1.98 | 1.76 | 0.85 | Not tested | Not tested |
| CHA.7.526 | 2.08 | 1.71 | 0.79 | Not tested | Not tested |
| CHA.7.527 | 1.16 | 0.99 | Not tested | Not tested | Not tested |
| CHA.7.528 | 3.08 | 3.63 | 12.2 | 1.21 | 1.18 |
| CHA.7.530 | 6.04 | 6.47 | 60.80 | 1.73 | 1.89 |
| CHA.7.534 | 2.60 | 1.96 | 46.27 | Not tested | Not tested |
| CHA.7.535 | 2.24 | 1.28 | 0.82 | Not tested | Not tested |
| CHA.7.537 | 3.90 | 3.41 | 1.55 | 1.18 | 1.19 |
| CHA.7.538 | 6.49 | 6.17 | 15.16 | 1.36 | 1.45 |
| CHA.7.543 | 4.48 | 4.33 | 0.83 | 1.35 | 1.39 |
| CHA.7.544 | 2.36 | 2.54 | 61.09 | Not tested | Not tested |
| CHA.7.545 | 2.54 | 2.82 | 0.91 | Not tested | Not tested |
| CHA.7.546 | 2.75 | 2.95 | 0.85 | Not tested | Not tested |
| CHA.7.547 | 2.21 | 1.13 | 26.65 | Not tested | Not tested |
| CHA.7.548 | 3.15 | 3.35 | 4.25 | 1.18 | 1.09 |
| CHA.7.549 | 3.05 | 1.42 | 1.00 | Not tested | Not tested |
| CHA.7.550 | 1.60 | 1.29 | 0.90 | Not tested | Not tested |

Figure 92

| Antibody (mIgG) | $IC_{50}$ (nM) |
|---|---|
| CHA.7.502 | 39.90 |
| CHA.7.503 | No $IC_{50}$ |
| CHA.7.506 | 31.65 |
| CHA.7.508 | 37.88 |
| CHA.7.510 | 55.00 |
| CHA.7.512 | 839.6 |
| CHA.7.514 | 38.88 |
| CHA.7.516 | 33.11 |
| CHA.7.518 | 23.15 |
| CHA.7.520 | 619.3 |
| CHA.7.522 | 50.48 |
| CHA.7.524 | 30.20 |
| CHA.7.525 | 85.52 |
| CHA.7.526 | 58.88 |
| CHA.7.527 | No $IC_{50}$ |
| CHA.7.528 | 28.88 |
| CHA.7.530 | 34.56 |
| CHA.7.534 | 181.4 |
| CHA.7.535 | 821.1 |
| CHA.7.537 | 38.95 |
| CHA.7.538 | 51.87 |
| CHA.7.543 | No $IC_{50}$ |
| CHA.7.544 | No $IC_{50}$ |
| CHA.7.545 | 96.06 |
| CHA.7.546 | 92.05 |
| CHA.7.547 | 27.94 |
| CHA.7.548 | 18.98 |
| CHA.7.549 | 36.12 |
| CHA.7.550 | 58.34 |

FIGURE 93A
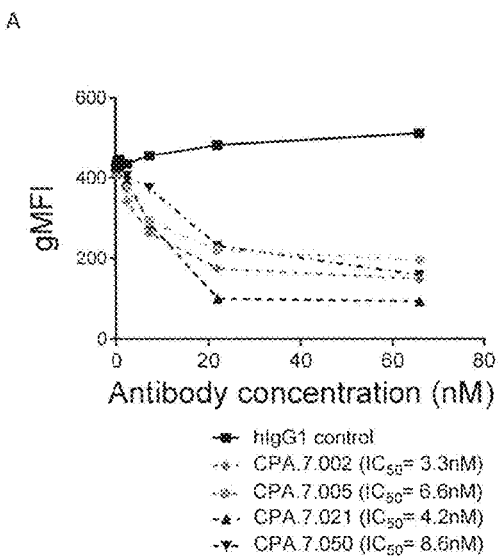
FIGURE 93B
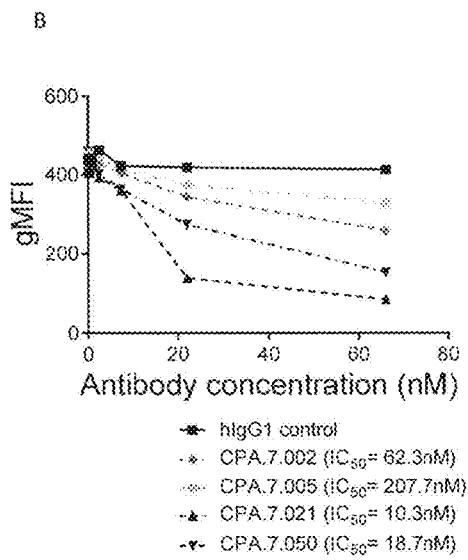
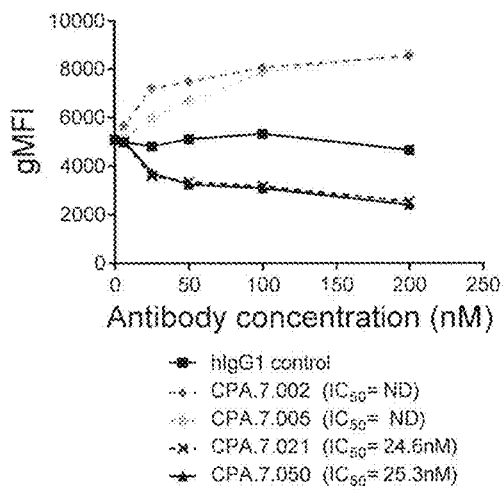
FIGURE 93C

FIG. 94A  FIG. 94B  FIG. 94C  FIG. 94D
a  b  c  d
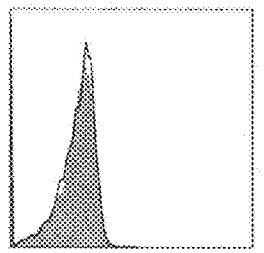 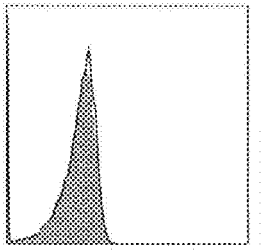 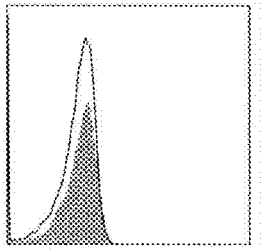 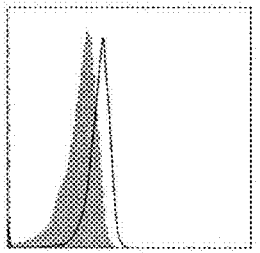
e  f  g  h
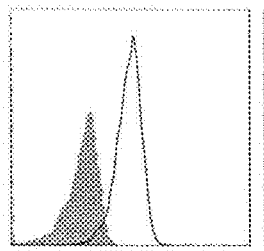 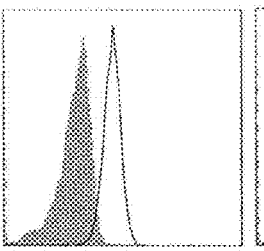 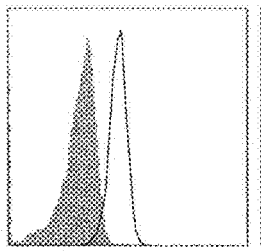 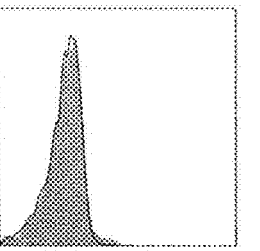
FIG. 94E  FIG. 94F  FIG. 94G  FIG. 94H FIG. 96A  FIG. 96B  FIG. 96C  FIG. 96D
a  b  c  d
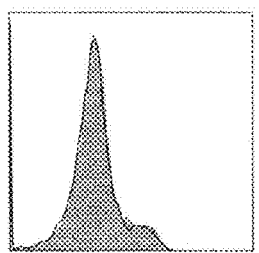 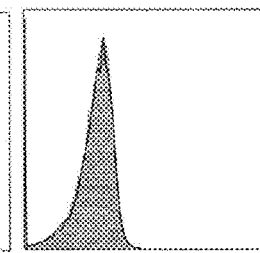 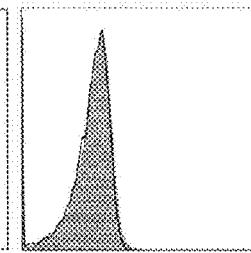 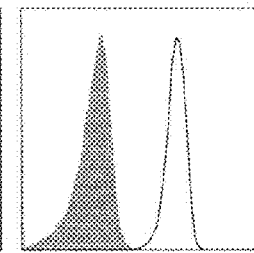
e  f  g  h
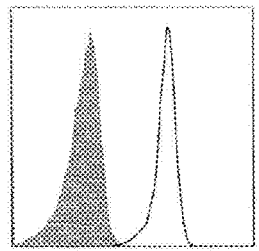 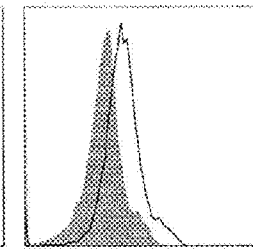 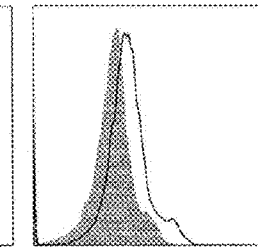 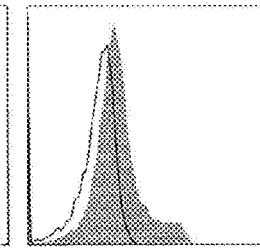
FIG. 96E  FIG. 96F  FIG. 96G  FIG. 96H A
FIGURE 97A
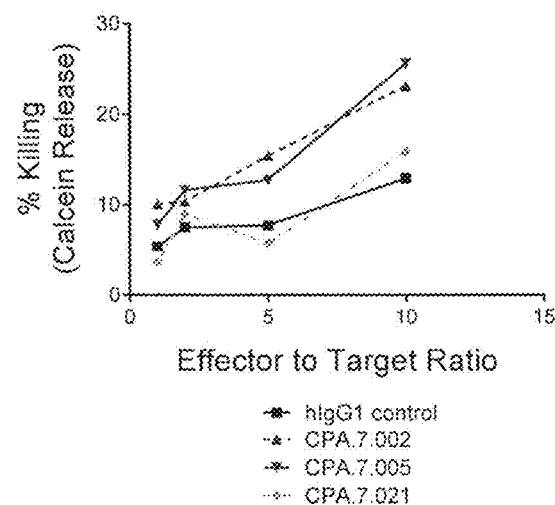
B
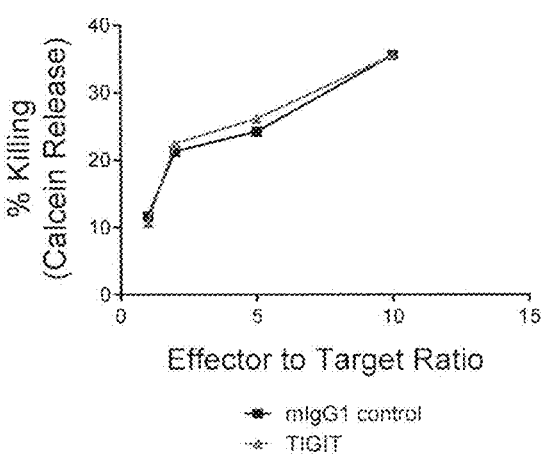
FIGURE 97B

Figure 98

| Antibody (hIgG1) | Assay permutation and orientation | IC$_{50}$ (nM) |
|---|---|---|
| CPA.7.002 | HEK + PVRIG Fc (P) | 3.3 |
| | HEK + PVRIG Fc (NP) | 62.3 |
| | HEK hPVRIG + PVRL2 Fc | Increased binding |
| CPA.7.005 | HEK + PVRIG Fc (P) | 6.6 |
| | HEK + PVRIG Fc (NP) | 207.7 |
| | HEK hPVRIG + PVRL2 Fc | Increased binding |
| CPA.7.021 | HEK + PVRIG Fc (P) | 4.2 |
| | HEK + PVRIG Fc (NP) | 10.3 |
| | HEK hPVRIG + PVRL2 Fc | 24.6 |
| CPA.7.036 | HEK + PVRIG Fc (P) | 6.9 |
| | HEK + PVRIG Fc (NP) | 10.9 |
| CPA.7.037 | HEK + PVRIG Fc (P) | 6.5 |
| | HEK + PVRIG Fc (NP) | 19.1 |
| CPA.7.038 | HEK + PVRIG Fc (P) | 3.5 |
| | HEK + PVRIG Fc (NP) | 6.7 |
| CPA.7.039 | HEK + PVRIG Fc (P) | 14.0 |
| | HEK + PVRIG Fc (NP) | 32.7 |
| CPA.7.041 | HEK + PVRIG Fc (P) | 5.8 |
| | HEK + PVRIG Fc (NP) | 16.2 |
| CPA.7.042 | HEK + PVRIG Fc (P) | 3.6 |
| | HEK + PVRIG Fc (NP) | 8.3 |
| CPA.7.050 | HEK + PVRIG Fc (P) | 8.6 |
| | HEK + PVRIG Fc (NP) | 18.7 |
| | HEKhPVRIG + PVRL2 Fc | 25.3 |

Figure 99

| Antibody (hIgG1) | Target Cell line | Fold change in cytotoxicity relative to control |
|---|---|---|
| CPA.7.002 | Reh | 2.9 |
| | MOLM-13 | 1.9 |
| CPA.7.005 | Reh | 1.6 |
| | MOLM-13 | 1.6 |
| CPA.7.021 | Reh | 1.9 |
| | MOLM-13 | 0.7 |
| CPA.7.036 | Reh | 0.9 |
| CPA.7.037 | Reh | 1.1 |
| CPA.7.038 | Reh | 0.8 |
| CPA.7.041 | Reh | 0.7 |
| CPA.7.042 | Reh | 0.7 |
| CPA.7.050 | Reh | 1.6 |
| TIGIT | Reh | 1.1 |
| | MOLM-13 | 1.1 |
| DNAM-1 | Reh | 1.2 |

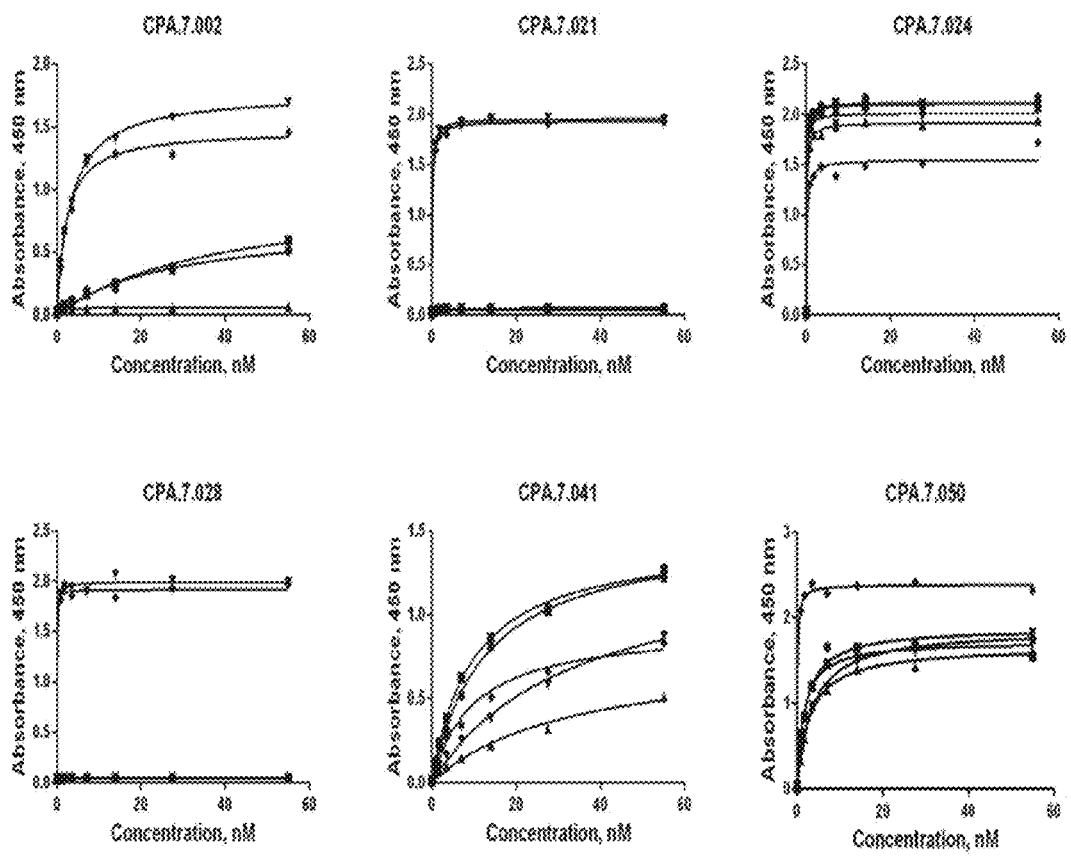

Figure 102

| mAb | Cyno cross-reactivity | Epitope bin | Epitope group |
|---|---|---|---|
| CPA.7.002 | + | 1 | 2 |
| CPA.7.021 | - | 1 | 1 |
| CPA.7.024 | +++ | 1 | 3 |
| CPA.7.028 | - | 1 | 1 |
| CPA.7.041 | ++ | 1 | 2 |
| CPA.7.050 | +++ | 4 | 3 |

Figure 103A

>PVRIG_NP_076975_from_41_to_171_Sequence_of_Human_WT_ECD_(without_SP) SEQ ID NO: 1467

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGS
LPPSSDPGLSAPPTPAPILRAD

Figure 103B

>PVRIG_NP_076975_from_21_to_171_Sequence_of_Human_WT_ECD_(with_SP) SEQ ID NO: 1468

MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCA
NTTFCCKFASFPEGSWEACGSLPPSSDPGLSAPPTPAPILRAD

Figure 103C

>PVRIG_NP_076975_from_43_to_146_Sequence_of_Ig_Domain SEQ ID NO: 1469

EVWVQVRMEATELSSFTIRCGFLGSGSISLVTVSWGGPNGAGGTTLAVLHPERGIRQWAPARQARWETQSSISLILEGSGASSPCA

Figure 103D

>PVRIG_Splice_Variant_P6 SEQ ID NO: 1470

MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCA
NTTFCCKFASFPEGSWEACGSLPPSSDPGLSAPPTPAPILRADLAGILGVSGVLLFGCVYLLHLLRRHKHR

Figure 103E

>PVRIG_Splice_Variant_P8 SEQ ID NO: 1471

MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCA
NTTFCCKFASFPEGSWEACGSLVPPTPAPILRADLAGILGVSGVLLFDCGYLLHLLCRQKHRPAPRLQPSHTSS

Figure 103F

>PVRIG_Splice_Variant_P4 SEQ ID NO: 1472

MGHRTLVLPWVLLTLCVTAGTPEVWVQVRMEATELSSFTIRWLSAPPTPAPILRADLAGILGVSGVILLFGCVYLLHLLRRHKHRPAPRLQPSRTSPQAPRARAWAPSQA
SQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

Figure 103G

>PVRIG_Splice_Variant_P7 SEQ ID NO: 1473

MGHRTLVLPWVLLTLCVTAGLSAPPTPAPILRADLAGILGVSGVILLFGCVYLLHLLRRHKHRPAPRLQPSRTSPQAPRARAWAPSQASQAALHVPYATINTSCRPATLDT
AHPHGGPSWWASLPTHAAHRPQGPAAWASTPIPARGSFVSVENGLYAQAGERPPHTGPGLTLFPDPRGPRAMEGPLGVR

Figure 103H

>PVRIG_Splice_Variant_P14 SEQ ID NO: 1474

MGHRTLVLPWVLLTLCVTAGLSVPPTPAPILRADLAGILGVSGVILLFDCGYLLHLLCRQKHRPAPRLQPSHTSS

Figure 103I

>PVRIG_Splice_Variant_P3 SEQ ID NO: 1475

MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCA
NTTFCCKFASFPEGSWEACGSLPPSSDPGGAGARGPGGQGGARELATHLILVSVPRALCPADSCPHSAGRPGRDLGGLRSPPLWLCLPPSSAAPT

Figure 103J

>PVRIG_Splice_Variant_P10 SEQ ID NO: 1476

MGHRTLVLPWVLLTLCVTAGTPEVWVQVRMEATELSSFTIRCGFLGSGSISLVTVSWGGPNGAGGTTLAVLHPERGAQISPRGPKIGGPPCPRPGPAGKPRAASLSSW
KALGPAAPAPTPPSAASLRPSQAALHVPYATINTSCRPATLDTAHPHGGPAAWASTPIPARGSFVSVENGLYAQAGERPPHTGPGLTLFPD
PRGPRAMEGPLGVR

Figure 103K

>PVRIG_Splice_Variant_P13 SEQ ID NO: 1477

MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCA
NTTFCCKFASFPGCSSRPLCHYQHQLPPSYFGHSSPPWGAVLVGVTPHPRCTPAPGPCRLGLHTHPCTWQLCLC

Figure 103L

>PVRIG_Splice_Variant_P3_ECD SEQ ID NO: 1478

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGS
LPPSSDPGGAGARGPGGQGGARELATHLILVSVPRALCPADSCPHSAGRPGRDLGGLRSPPLWLCLPPSSAAPT

Figure 103M

>PVRIG_Splice_Variant_P10_ECD SEQ ID NO: 1479

TPEVWVQVRMEATELSSFTIRCGFLGSGSISLVTVSWGGPNGAGGTTLAVLHPERGAQISPRGPKIGGPPCPRPGPAGKPRAASLSSWKALGPAAPAPTPPSAASLRPS
QAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

Figure 103N

>PVRIG_Splice_Variant_P13_ECD SEQ ID NO: 1480

TPEVWVQVRMEATELSSFTIRCGFLGSGSISLVTVSWGGPNGAGGTTLAVLHPERGIRQWAPARQARWETQSSISLILEGSGASSPCANTTFCCKFASFPGCSSRPLCHY
QHQLPPSYFGHSSPPWGAVLVGVTPHPRCTPAPGPCRLGLHTHPCTWQLCLC

Figure 103O

>PVRIG_Splice_Variant_P3_ECD_Unique SEQ ID NO: 1481

GAGARGPGGQGGARELATHLILVSVPRALCPADSCPHSAGRPGRDLGGLRSPPLWLCLPPSSAAPT

Figure 103P

>PVRIG_Splice_Variant_P10_ECD_All_Unique SEQ ID NO: 1482

AQISPRGPKIGGPPCPRPGPAGKPRAASLSSWKALGPAAAPTPPSAASLRPSQAALHVPYATINTSCRPATLDTAHPHGGPSWWASLPTHAAHRPQGPAAWASTPIP
ARGSFVSVENGLYAQAGERPPHTGPGLTLFPDPRGPRAMEGPLGVR

Figure 103Q

>PVRIG_Splice_Variant_P10_ECD_Unique_without_intracellular SEQ ID NO: 1483

AQISPRGPKIGGPPCPRPGPAGKPRAASLSSWKALGPAAAPTPPSAASLRP

Figure 103R

>PVRIG_Splice_Variant_P13_ECD_Unique SEQ ID NO: 1484

GCSSRPLCHYQHQLPPSYFGHSSPPWGAVLVGVTPHPRCTPAPGPCRLGLHTHPCTWQLCLC

Figure 103S

>PVRIG_NP_076975_from_41_to_169_variation_of_ECD_(without_SP) SEQ ID NO: 1485

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGS
LPPSSDPGLSAPPTPAPILR

Figure 103T

>PVRIG_NP_076975_from_41_to_170_variation_of_ECD_(without_SP) SEQ ID NO: 1486

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGS
LPPSSDPGLSAPPTPAPILRA

Figure 103U

>PVRIG_NP_076975_from_41_to_172_variation_of_ECD_(without_SP) SEQ ID NO: 1487

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGS
LPPSSDPGLSAPPTPAPILRADL

Figure 103V

>PVRIG_NP_076975_from_41_to_173_variation_of_ECD_(without_SP) SEQ ID NO: 1488

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGS
LPPSSDPGLSAPPTPAPILRADLA

Figure 103W

>PVRIG_NP_076975_from_41_to_144_variation_of_Ig_Domain SEQ ID NO: 1489

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSW

Figure 103X

>PVRIG_NP_076975_from_41_to_145_variation_of_Ig_Domain SEQ ID NO: 1490

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

Figure 103Y

>PVRIG_NP_076975_from_41_to_146_variation_of_Ig_Domain SEQ ID NO: 1491

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

Figure 103Z

>PVRIG_NP_076975_from_41_to_147_variation_of_Ig_Domain SEQ ID NO: 1492
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

Figure 103AA

>PVRIG_NP_076975_from_41_to_148_variation_of_Ig_Domain SEQ ID NO: 1493
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

Figure 103AB

>PVRIG_NP_076975_from_42_to_144_variation_of_Ig_Domain SEQ ID NO: 1494
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSW

Figure 103AC

>PVRIG_NP_076975_from_42_to_145_variation_of_Ig_Domain SEQ ID NO: 1495
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

Figure 103AD

>PVRIG_NP_076975_from_42_to_146_variation_of_Ig_Domain SEQ ID NO: 1496
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

Figure 103AE

>PVRIG_NP_076975_from_42_to_147_variation_of_Ig_Domain SEQ ID NO: 1497
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

Figure 103AF

>PVRIG_NP_076975_from_42_to_148_variation_of_Ig_Domain SEQ ID NO: 1498
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

Figure 103AG

>PVRIG_NP_076975_from_43_to_144_variation_of_Ig_Domain SEQ ID NO: 1499
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSW

Figure 103AH

>PVRIG_NP_076975_from_43_to_145_variation_of_Ig_Domain SEQ ID NO: 1500
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

Figure 103AI

>PVRIG_NP_076975_from_43_to_147_variation_of_Ig_Domain SEQ ID NO: 1501
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

Figure 103AJ

>PVRIG_NP_076975_from_43_to_148_variation_of_Ig_Domain SEQ ID NO: 1502
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

Figure 103AK

>PVRIG_NP_076975_from_44_to_144_variation_of_Ig_Domain SEQ ID NO: 1503
VWVQVRMEATELSSFTIRCGFLGSGSISLVTVSWGGPNGAGGTTLAVLHPERGIRQWAPARQARWETQSSISLILEGSGASSPCANTTFCCKFASFPEGSW

Figure 103AL

>PVRIG_NP_076975_from_44_to_145_variation_of_Ig_Domain SEQ ID NO: 1504
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

Figure 103AM

>PVRIG_NP_076975_from_44_to_146_variation_of_Ig_Domain SEQ ID NO: 1505
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

Figure 103AN

>PVRIG_NP_076975_from_44_to_147_variation_of_Ig_Domain SEQ ID NO: 1506
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

Figure 103AO

>PVRIG_NP_076975_from_44_to_148_variation_of_Ig_Domain SEQ ID NO: 1507
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

Figure 103AP

>PVRIG_NP_076975_from_45_to_144_variation_of_Ig_Domain SEQ ID NO: 1508
WVQVRMEATELSSFTIRCGFLGSGSISLVTVSWGGPNGAGGTTLAVLHPERGIRQWAPARQARWETQSSISLILEGSGASSPCANTTFCCKFASFPEGSW

Figure 103AQ

>PVRIG_NP_076975_from_45_to_145_variation_of_Ig_Domain SEQ ID NO: 1509
WVQVRMEATELSSFTIRCGFLGSGSISLVTVSWGGPNGAGGTTLAVLHPERGIRQWAPARQARWETQSSISLILEGSGASSPCANTTFCCKFASFPEGSWE

Figure 103AR

>PVRIG_NP_076975_from_45_to_146_variation_of_Ig_Domain SEQ ID NO: 1510

WVQVRMEATELSSFTIRCGFLGSGSISLVTVSWGGPNGAGGTTLAVLHPERGIRQWAPARQARWETQSSISLILEGSGASSPCANTTFCCKFASPPEGSWEA

Figure 103AS

>PVRIG_NP_076975_from_45_to_147_variation_of_Ig_Domain SEQ ID NO: 1511

WVQVRMEATELSSFTIRCGFLGSGSISLVTVSWGGPNGAGGTTLAVLHPERGIRQWAPARQARWETQSSISLILEGSGASSPCANTTFCCKFASPPEGSWEAC

Figure 103AT

>PVRIG_NP_076975_from_45_to_148_variation_of_Ig_Domain SEQ ID NO: 1512

WVQVRMEATELSSFTIRCGFLGSGSISLVTVSWGGPNGAGGTTLAVLHPERGIRQWAPARQARWETQSSISLILEGSGASSPCANTTFCCKFASPPEGSWEACG

Figure 103AU

>PVRIG_XP_006544085_PREDICTED_transmembrane_protein_PVRIG-like_isoform_X2_[Mus_musculus] SEQ ID NO: 1513

MRTGNTQAAHATNMGQMQTLVLFSTLLTLCVSEASPEVWVQVQMEATNLSSFSVHCGVLGYSLISLVTVSCEGFVDAGRTKLAVLHPEFGTQQWAPARQAHWETP
NSVSVTLTMGQSKARSSLANTTFCCEFVTFPHGSRVACRDLHRSDPGLSAPTPALNLQADLVRILGTSGVFLFGFIFILCLRWQQRHWCLSKSQPSLTSTQAQVETQPPHL
ASTHSSFISMENGLYALA

Figure 103AV

>PVRIG_2nd_Met_Mouse_WT SEQ ID NO: 1514

MGQMQTLVLFSTLLTLCVSEASPEVWVQVQMEATNLSSFSVHCGVLGYSLISLVTVSCEGFVDAGRTKLAVLHPEFGTQQWAPARQAHWETPNSVSVTLTMGQSKA
RSSLANTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISMENGLY
ALA

Figure 103AW

>PVRIG_Mouse_WT_ECD_(without_SP) SEQ ID NO: 1515

SPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRV
ACRDLHRSDPGLSAPTPALNLQAD

Figure 103AX

>PVRIG_Mouse_WT_ECD_(with_SP) SEQ ID NO: 1516

MGQMQTLVLFSTLLTLCVSEASPEVWVQVQMEATNLSSFSVHCGVLGYSLISLVTVSCEGFVDAGRTKLAVLHPEFGTQQWAPARQAHWETPNSVSVTLTMGQSKA
RSSLANTTFCCEFVTFPHGSRVACRDLHRSDPGLSAPTPALNLQAD

Figure 103AY

>PVRIG_HH-1_(Human_ECD_+_human_IgG1_Fc_mutated_C220S_at_hinge)_-_without_SP SEQ ID NO: 1517

TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGS
LPPSSDPGLSAPPTPAPILRADEPKSSDKTHTCPPCPAPELLGGPSVFLFPPKPKDTLMISRTPEVTCVVVDVSHEDPEVKFNWYVDGVEVHNAKTKPREEQYNSTYRVVS
VLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKS
RWQQGNVFSCSVMHEALHNHYTQKSLSLSPGK

Figure 103AZ

>PVRIG_HH-1-1_(Human_ECD_with_C127F_and_C147S_mutations_+_human_IgG1_Fc_mutated_C220S_at_hinge)_-_without_SP SEQ ID NO: 1518

TPEVWVQVRMEATELSSFTIRCGFLGSGSISLVTVSWGGPNGAGGTTLAVLHPERGIRQWAPARQARWETQSSISLILEGSGASSPFANTTFCCKFASFPEGSWEASGSL
PPSSDPGLSAPPTPAPILRADEPKSSDKTHTCPPCPAPELLGGPSVFLFPPKPKDTLMISRTPEVTCVVVDVSHEDPEVKFNWYVDGVEVHNAKTKPREEQYNSTYRVVSV
LTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSR
WQQGNVFSCSVMHEALHNHYTQKSLSLSPGK

Figure 103BA

>PVRIG_HH-2_(Human_ECD_+_Human_IgG1_Fc_mutated_at_C220S,_C226S,_C229S_of_hinge)_-_without_SP SEQ ID NO: 1519

TPEVWVQVRMEATELSSFTIRCGFLGSGSISLVTVSWGGPNGAGGTTLAVLHPERGIRQWAPARQARWETQSSISILEGSSASSPCANTTFCCKFASFPEGSWEACGS
LPPSSDPGLSAPPTPAPILRADEPKSSDKTHTSPPSPAPELLGGPSVFLFPPKPKDTLMISRTPEVTCVVVDVSHEDPEVKFNWYVDGVEVHNAKTKPREEQYNSTYRVVS
VLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKS
RWQQGNVFSCSVMHEALHNHYTQKSLSLSPGK

Figure 103BB

>PVRIG_HH-2-1-1_(Human_ECD_with_C127F_mutation_+_Human_IgG1_Fc_mutated_at_C220S,_C226S,_C229S_of_hinge_encoded_by_natural_codons_instead_of_codons_optimized_for_CHO_cells)_-_without_SP SEQ ID NO: 1520

TPEVWVQVRMEATELSSFTIRCGFLGSGSISLVTVSWGGPNGAGGTTLAVLHPERGIRQWAPARQARWETQSSISILEGSSASSPFANTTFCCKFASFPEGSWEACGSL
PPSSDPGLSAPPTPAPILRADEPKSSDKTHTSPPSPAPELLGGPSVFLFPPKPKDTLMISRTPEVTCVVVDVSHEDPEVKFNWYVDGVEVHNAKTKPREEQYNSTYRVVSV
LTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSR
WQQGNVFSCSVMHEALHNHYTQKSLSLSPGK

Figure 103BC

>PVRIG_MM-1_(Mouse_ECD_+_mouse_IgG2a_Fc)_-_without_SP SEQ ID NO: 1521

SPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRV
ACRDLHRSDPGLSAPTPALNLQADEPRGPTIKPCPPCKCPAPNLLGGPSVFIFPPKIKDVLMISLSPIVTCVVVDVSEDDPDVQISWFVNNVEVHTAQTQTHREDYNSTLR
VVSALPIQHQDWMSGKEFKCKVNNKDLPAPIERTISKPKGSVRAPQVYVLPPEEEMTKKQVTLTCMVTDFMPEDIYVEWTNNGKTELNYKNTEPVLDSDGSYFMYSK
LRVEKKNWVERNSYSCSVVHEGLHNHHTTKSFSRTPGK

Figure 103BD

>PVRIG_MM-1-1_(Mouse_ECD_+_mouse_IgG2a_Fc_with_3_C_mutated_to_S_at_hinge)_-_without_SP SEQ ID NO: 1522

SPEVWVQVQMEATNLSSFSVHCGVLGYSLISLVTVSCEGFVDAGRTKLAVLHPEFGTQQWAPARQAHWETPNSVSVTLMGQSKARSSLANTTFCCEFVTFPHGSRV
ACRDLHRSDPGLSAPTPALNLQADEPRGPTIKPSPPSKSPAPNLLGGPSVFIFPPKIKDVLMISLSPIVTCVVVDVSEDDPDVQISWFVNNVEVHTAQTQTHREDYNSTLR
VVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSK
LRVEKKNWVERNSYSCSVHEGLHNHHTTKSFSRTPGK

Figure 103BE

>Human_Fc_(IgG1) SEQ ID NO: 1523

EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVS
NKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHN
HYTQKSLSLSPGK

Figure 103BF

>Human_Fc_(IgG1)_C220S SEQ ID NO: 1524

EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVS
NKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHN
HYTQKSLSLSPGK

Figure 103BG

>Human_Fc_(IgG1)_with_the_C220S_(at_hinge)_and_N297A_mutations SEQ ID NO: 1525

EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVS
NKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHN
HYTQKSLSLSPGK

Figure 103BH

>Human_Fc_(IgG1)_without_hinge SEQ ID NO: 1526

APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

Figure 103BI

>Mouse_Fc_(IgG2a) SEQ ID NO: 1527

EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVN
NKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLH
NHHTTKSFSRTPGK

Figure 103BJ

>Mouse_Fc_(IgG2a)_Fc_with_the_N297A_mutation SEQ ID NO: 1528

EPRGPTIKPCPPCKCPAPNLLGGPSVFIFPPKIKDVLMISLSPIVTCVVVDVSEDDPDVQISWFVNNVEVHTAQTQTHREDYASTLRVVSALPIQHQDWMSGKEFKCKVN
NKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLH
NHHTTKSFSRTPGK

Figure 103BK

>Mouse_Fc_(IgG2a)_without_hinge SEQ ID NO: 1529

APNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPK
GSVRAPQVYVLPPPEEMTKKQVTLTCMVTDFMPEDIYVEWTNNGKTELNYKNTEPVLDSDGSYFMYSKLRVEKKNWVERNSYSCSVVHEGLHNHHTTKSFSFSRTPGK

Figure 103BL

>Human_Fc_(IgG1)_with_the_C220S_C226S_C229S_mutations_(at_hinge) SEQ ID NO: 1530
EPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVS
NKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHN
HYTQKSLSLSPGK

Figure 103BM

>PVRIG_PRIMER_200-554_m15029_F    SEQ ID NO: 1531
CCACCAACCTCTCGTCTTTC

Figure 103BN

>PVRIG_PRIMER_200-553_m15029_R    SEQ ID NO: 1532
TCATGCCAGAGCATACAG

Figure 103BO

>PVRIG_PRIMER_200-571_m15029_F    SEQ ID NO: 1533
CAGTGCCTCTAACTGCTGAC

Figure 103BP

>PVRIG_PRIMER_200-572_m15029_R    SEQ ID NO: 1534
TCACTGTTACCAGGGAGATGAG

Figure 103BQ

>PVRIG_PRIMER_200-549_m15029_F    SEQ ID NO: 1535

CACAGGCTGCCCATGCAAC

Figure 103BR

>PVRIG_PRIMER_200-551_m15029_R    SEQ ID NO: 1536

TGCCTGGGTGCTAGTGAGAG

Figure 103BS

>PVRIG_PRIMER_200-554_m15029_F    SEQ ID NO: 1537

CCACCAACCTCTCGTCTTTC

Figure 103BT

>PVRIG_PRIMER_200-546_m15029_R    SEQ ID NO: 1538

GACCCTGTTACCTGTCATTG

Figure 103BU

>PVRIG_flag_protein SEQ ID NO: 1539

MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCA
NTTFCCKFASFPEGSWEACGSLPPSSDPGISAPPTPAPILRADLAGILGVSGVLLFGCVYLLHLLRRHKHRPAPRLQPSRTSPQAPRARAWAPSQASQAALHVPYATINTS
CRPATLDTAHPHGGPSWWASLPTHAAHRPQGPAAWASTPIPARGSFVSVENGLYAQAGERPPHTGPGLTLFPDPRGPRAMEGPLGVRDYKDDDDK

Figure 103BV

>PVRIG_Mouse_First_Methionine_signal_peptide-Flag-ECD SEQ ID NO: 1540

MRTGNTQAAHATNMGQMQTLVLFSTLLTLCVSEADYKDDDDKSPEVWVQVQMEATNLSSFSVHCGVLGYSLISLVTVSCEGFVDAGRTKLAVLHPEFGTQQWAPAR QAHWETPNSVSVTLTMGQSKARSSLANTTFCCEFVTFPHGSRVACRDLHRSDPGLSAPTPALNLQADLVRILGTSGVFLFGFIFILCLRWQQRHWCLSKSQPSLTSTQAQ VETQPPHLASTHSSFISMENGLYALA

Figure 103BW

>PVRIG_Mouse_Third_Methionine_untagged SEQ ID NO: 1541

MQTLVLFSTLLTLCVSEASPEVWVQVQMEATNLSSFSVHCGVLGYSLISLVTVSCEGFVDAGRTKLAVLHPEFGTQQWAPARQAHWETPNSVSVTLTMGQSKARSSLA NTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISMENGLYALA

Figure 103BX

>PVRIG_Mouse_Third_Methionine_signal peptide-Flag-ECD SEQ ID NO: 1542

MQTLVLFSTLLTLCVSEADYKDDDDKSPEVWVQVQMEATNLSSFSVHCGVLGYSLISLVTVSCEGFVDAGRTKLAVLHPEFGTQQWAPARQAHWETPNSVSVTLTMG QSKARSSLANTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISME NGLYALA

US 9,714,289 B2

ANTI-PVRIG ANTIBODIES AND METHODS OF USE

CROSS REFERENCE TO RELATED APPLICATIONS

This application is a continuation of U.S. patent application Ser. No. 15/048,967, filed Feb. 19, 2016 which claims priority under 35 U.S.C. §119 to U.S. Ser. No. 62/118,208, filed Feb. 19, 2015, and to U.S. Ser. No. 62/141,120, filed Mar. 31, 2015, and to U.S. Ser. No. 62/235,823, filed Oct. 1, 2015, all of which are expressly incorporated herein by reference in their entirety.

The instant application contains a Sequence Listing which has been submitted electronically in ASCII format and is hereby incorporated by reference in its entirety. Said ASCII copy, created on Apr. 13, 2016 and edited on Sep. 27, 2016, is named 114386-5002-US01_SL.txt and is 874,724 bytes in size.

BACKGROUND OF THE INVENTION

Naïve T cells must receive two independent signals from antigen-presenting cells (APC) in order to become productively activated. The first, Signal 1, is antigen-specific and occurs when T cell antigen receptors encounter the appropriate antigen-MHC complex on the APC. The fate of the immune response is determined by a second, antigen-independent signal (Signal 2) which is delivered through a T cell costimulatory molecule that engages its APC-expressed ligand. This second signal could be either stimulatory (positive costimulation) or inhibitory (negative costimulation or coinhibition). In the absence of a costimulatory signal, or in the presence of a coinhibitory signal, T-cell activation is impaired or aborted, which may lead to a state of antigen-specific unresponsiveness (known as T-cell anergy), or may result in T-cell apoptotic death.

Costimulatory molecule pairs usually consist of ligands expressed on APCs and their cognate receptors expressed on T cells. The prototype ligand/receptor pairs of costimulatory molecules are B7/CD28 and CD40/CD40L. The B7 family consists of structurally related, cell-surface protein ligands, which may provide stimulatory or inhibitory input to an immune response. Members of the B7 family are structurally related, with the extracellular domain containing at least one variable or constant immunoglobulin domain.

Both positive and negative costimulatory signals play critical roles in the regulation of cell-mediated immune responses, and molecules that mediate these signals have proven to be effective targets for immunomodulation. Based on this knowledge, several therapeutic approaches that involve targeting of costimulatory molecules have been developed, and were shown to be useful for prevention and treatment of cancer by turning on, or preventing the turning off, of immune responses in cancer patients and for prevention and treatment of autoimmune diseases and inflammatory diseases, as well as rejection of allogenic transplantation, each by turning off uncontrolled immune responses, or by induction of "off signal" by negative costimulation (or coinhibition) in subjects with these pathological conditions.

Manipulation of the signals delivered by B7 ligands has shown potential in the treatment of autoimmunity, inflammatory diseases, and transplant rejection. Therapeutic strategies include blocking of costimulation using monoclonal antibodies to the ligand or to the receptor of a costimulatory pair, or using soluble fusion proteins composed of the costimulatory receptor that may bind and block its appropriate ligand. Another approach is induction of co-inhibition using soluble fusion protein of an inhibitory ligand. These approaches rely, at least partially, on the eventual deletion of auto- or allo-reactive T cells (which are responsible for the pathogenic processes in autoimmune diseases or transplantation, respectively), presumably because in the absence of costimulation (which induces cell survival genes) T cells become highly susceptible to induction of apoptosis. Thus, novel agents that are capable of modulating costimulatory signals, without compromising the immune system's ability to defend against pathogens, are highly advantageous for treatment and prevention of such pathological conditions.

Costimulatory pathways play an important role in tumor development. Interestingly, tumors have been shown to evade immune destruction by impeding T cell activation through inhibition of co-stimulatory factors in the B7-CD28 and TNF families, as well as by attracting regulatory T cells, which inhibit anti-tumor T cell responses (see Wang (2006), "Immune Suppression by Tumor Specific CD4$^+$ Regulatory T cells in Cancer", Semin. Cancer. Biol. 16:73-79; Greenwald, et al. (2005), "The B7 Family Revisited", Ann. Rev. Immunol. 23:515-48; Watts (2005), "TNF/TNFR Family Members in Co-stimulation of T Cell Responses", Ann. Rev. Immunol. 23:23-68; Sadum, et al., (2007) "Immune Signatures of Murine and Human Cancers Reveal Unique Mechanisms of Tumor Escape and New Targets for Cancer Immunotherapy", Clin. Canc. Res. 13(13): 4016-4025). Such tumor expressed co-stimulatory molecules have become attractive cancer biomarkers and may serve as tumor-associated antigens (TAAs). Furthermore, costimulatory pathways have been identified as immunologic checkpoints that attenuate T cell dependent immune responses, both at the level of initiation and effector function within tumor metastases. As engineered cancer vaccines continue to improve, it is becoming clear that such immunologic checkpoints are a major barrier to the vaccines' ability to induce therapeutic anti-tumor responses. In that regard, costimulatory molecules can serve as adjuvants for active (vaccination) and passive (antibody-mediated) cancer immunotherapy, providing strategies to thwart immune tolerance and stimulate the immune system.

Over the past decade, agonists and/or antagonists to various costimulatory proteins have been developed for treating autoimmune diseases, graft rejection, allergy and cancer. For example, CTLA4-Ig (Abatacept, Orencia®) is approved for treatment of RA, mutated CTLA4-Ig (Belatacept, Nulojix®) for prevention of acute kidney transplant rejection and by the anti-CTLA4 antibody (Ipilimumab, Yervoy®), recently approved for the treatment of melanoma. Other costimulation regulators have been approved, such as the anti-PD-1 antibodies of Merck (Keytruda®) and BMS (Opdivo®), have been approved for cancer treatments and are in testing for viral infections as well.

Accordingly, it is an object of the invention to provide PVRIG immunomodulatory antibodies.

BRIEF SUMMARY OF THE INVENTION

Accordingly, it is an object of the invention to provide methods of activating cytotoxic T cells (CTLs) of a patient comprising administering an anti-PVRIG antibody to the patient, wherein a subset of the CTLs of the patient are activated.

It is a further object of the invention to provide methods of activating NK cells of a patient comprising administering an anti-PVRIG antibody to the patient, wherein a subset of the NK cells of the patient are activated.

It is an additional object of the invention to provide methods of activating γδ T cells of a patient comprising administering an anti-PVRIG antibody to the patient, wherein a subset of the γδ T cells of the patient are activated.

It is a further object of the invention to provide methods of activating Th1 cells of a patient comprising administering an anti-PVRIG antibody to the patient, wherein a subset of the Th1 cells of the patient are activated.

It is an additional object of the invention to provide methods of inhibiting the interaction of PVRIG and PVLR2 in a patient having a condition associated with this interaction comprising administering an anti-PVRIG antibody to the patient.

It is a further object of the invention to provide methods of treating cancer in a patient, comprising administering an anti-PVRIG antibody to the patient, wherein said cancer is treated.

It is an additional object of the invention to provide methods as outlined above wherein the anti-PVRIG antibody comprises the vhCDR1, vhCDR2, vhCDR3, vlCDR1, vlCDR2 and vlCDR3 sequences from an antibody selected from the group consisting of CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is an additional object of the invention to provide methods as outlined above wherein the anti-PVRIG antibody competes for binding with an antibody comprising the vhCDR1, vhCDR2, vhCDR3, vlCDR1, vlCDR2 and vlCDR3 sequences from an antibody selected from the group consisting of CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is a further object of the invention to provide methods as outlined above wherein the anti-PVRIG antibody is selected from the group consisting of CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is an additional object of the invention to provide methods as outlined above wherein the anti-PVRIG antibody competes for binding with an antibody selected from the group consisting of CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is a further object of the invention to provide methods as outlined above wherein the anti-PVRIG antibody comprises the vhCDR1, vhCDR2, vhCDR3, vlCDR1, vlCDR2 and vlCDR3 sequences from an antibody selected from the group consisting of CHA.7.502, CHA.7.503, CHA.7.506, CHA.7.508, CHA.7.510, CHA.7.512, CHA.7.514, CHA.7.516, CHA.7.518, CHA.7.520.1, CHA.7.520.2, CHA.7.522, CHA.7.524, CHA.7.526, CHA.7.527, CHA.7.528, CHA.7.530, CHA.7.534, CHA.7.535, CHA.7.537, CHA.7.538.1, CHA.7.538.2, CHA.7.543, CHA.7.544, CHA.7.545, CHA.7.546, CHA.7.547, CHA.7.548, CHA.7.549, CHA.7.550, CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is an additional object of the invention to provide methods as outlined above wherein said the-PVRIG antibody competes for binding with an antibody selected from the group consisting of an anti-PVRIG antibody comprising the vhCDR1, vhCDR2, vhCDR3, vlCDR1, vlCDR2 and vlCDR3 sequences from an antibody selected from the group consisting of CHA.7.502, CHA.7.503, CHA.7.506, CHA.7.508, CHA.7.510, CHA.7.512, CHA.7.514, CHA.7.516, CHA.7.518, CHA.7.520.1, CHA.7.520.2, CHA.7.522, CHA.7.524, CHA.7.526, CHA.7.527, CHA.7.528, CHA.7.530, CHA.7.534, CHA.7.535, CHA.7.537, CHA.7.538.1, CHA.7.538.2, CHA.7.543, CHA.7.544, CHA.7.545, CHA.7.546, CHA.7.547, CHA.7.548, CHA.7.549, CHA.7.550, CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is a further object of the invention to provide methods of diagnosing cancer comprising a) contacting a tissue from a patient with an anti-PVRIG antibody; and b) determining the presence of over-expression of PVRIG in the tissue as an indication of the presence of cancer. The anti-PVRIG antibody can be as described herein and as outlined above.

It is an additional object of the invention to provide antigen binding domains, including antibodies, which are anti-PVRIG antibodies, comprising the vhCDR1, vhCDR2, vhCDR3, vlCDR1, vlCDR2 and vlCDR3 sequences from an antibody selected from the group consisting of CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is a further object of the invention to provide anti-PVRIG antigen binding domains (including antibodies) compositions that are anti-PVRIG antibodies, selected from the group consisting of CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is a further object of the invention to provide anti-PVRIG antigen binding domains (including antibodies) compositions that are anti-PVRIG antibodies, selected from the group consisting of h518-1, h518-2, h518-3, h518-4, h518-5, h524-1, h524-2, h524-3, h524-4, h530-1, h530-2, h530-3, h530-4, h530-5, h538.1-1, h538.1-2, h538.1-3, h538.1-4, h538.2-1, h538.2-2, and h538.2-3 (as depicted in FIG. 90).

It is an additional object of the invention to provide antigen binding domains, including antibodies, which are anti-PVRIG antibodies, comprising the vhCDR1, vhCDR2, vhCDR3, vlCDR1, vlCDR2 and vlCDR3 sequences from an antibody selected from the group consisting of CHA.7.502, CHA.7.503, CHA.7.506, CHA.7.508, CHA.7.510, CHA.7.512, CHA.7.514, CHA.7.516, CHA.7.518, CHA.7.520.1, CHA.7.520.2, CHA.7.522, CHA.7.524, CHA.7.526, CHA.7.527, CHA.7.528, CHA.7.530, CHA.7.534, CHA.7.535, CHA.7.537, CHA.7.538.1, CHA.7.538.2, CHA.7.543, CHA.7.544, CHA.7.545, CHA.7.546, CHA.7.547, CHA.7.548, CHA.7.549, CHA.7.550, CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is a further object of the invention to provide nucleic acid compositions comprising: a) a first nucleic acid encoding the a heavy chain variable domain comprising the vhCDR1, vhCDR2 and vhCDR3 from an antibody; and b) a second nucleic acid encoding a light chain variable domain comprising vlCDR1, vlCDR2 and and vlCDR3 from an antibody. The antibody is selected from the group consisting of CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, CPA.7.050, CHA.7.502, CHA.7.503, CHA.7.506, CHA.7.508, CHA.7.510, CHA.7.512, CHA.7.514, CHA.7.516, CHA.7.518, CHA.7.520.1, CHA.7.520.2, CHA.7.522, CHA.7.524, CHA.7.526, CHA.7.527, CHA.7.528, CHA.7.530, CHA.7.534, CHA.7.535, CHA.7.537, CHA.7.538.1, CHA.7.538.2, CHA.7.543, CHA.7.544, CHA.7.545, CHA.7.546, CHA.7.547, CHA.7.548, CHA.7.549, CHA.7.550, CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050.

It is an additional object of the invention to provide expression vector compositions comprising the first and second nucleic acids as outlined herein and above.

It is a further object of the invention to provide host cells comprising the expression vector compositions, either as single expression vectors or two expression vectors.

It is an additional object of the invention to provide methods of making an anti-PVRIG antibody comprising a) culturing a host cell of the invention with expression vector(s) under conditions wherein the antibody is produced; and b) recovering the antibody.

BRIEF DESCRIPTION OF THE DRAWINGS

FIG. 5A resents mRNA expression of PVRIG in specific cell populations obtained by laser capture microscopy (based on GSE39397). FIG. 5B presents mRNA expression of PVRIG in CD4 T-cells from normal and cancer patient as well as expression form CD4 T-cell expression from draining lymph nodes and TILs form breast cancer patients (based on GSE36765). FIG. 5C presents mRNA expression of PVRIG from CD8 and CD4 T-cells derived from follicular lymphoma tumor and tonsil (based on GSE27928).

FIG. 25 depicts the full length sequence of human PVRIG (showing two different methionine starting points) and the PVRIG Fc fusion protein used in the Examples. The signal peptide is underlined, the ECD is double underlined, and the Fc domain is the dotted underlining.

FIG. 26 depicts the sequence of the human Poliovirus receptor-related 2 protein (PVLR2, also known as nectin-2, CD112 or herpesvirus entry mediator B, (HVEB)), the binding partner of PVRIG as shown in Example 5. PVLR2 is a human plasma membrane glycoprotein.

FIG. 30A: PVRIG RNA was assessed in sorted CD4 T cells (CD4) and NK cells (NK) under naïve and activated conditions by qPCR. CD4 T cells were stimulated with human T cell stimulator dynabeads and 50 U/ml IL-2 for 3 days. NK cells were stimulated in 50 U/ml IL-2 for 3 days. Data shown is relative expression of PVRIG RNA in each subset as fold change over levels in expi cells as assessed by the $2^{(-\Delta\Delta Ct)}$ method. Jurkat is included as a positive control. D47-D49 denote three individual donors. FIG. 30B PVRIG RNA was assessed in sorted CD8 T cells under naïve and activated conditions by qPCR. CD8 T cells were stimulated with human T cell stimulator dynabeads and 100 U/ml IL-2 for 3 days. Data shown is relative expression of PVRIG RNA in each subset as fold change over levels in expi cells as assessed by the $2^{(-\Delta\Delta Ct)}$ method. Jurkat is included as a positive control. D49, 70, and 71 indicate three individual donors.

FIGS. 31A-31B PVRIG binding characteristics to HEK hPVRIG engineered cell lines, HEK parental cells, CA46 cells, and Jurkat cells. HEK OE denotes HEK hPVRIG cells, HEK par denotes HEK parental cells. For Jurkat and CA46 data, gMFIr indicates the fold difference in geometric MFI of PVRIG antibody staining relative to their controls. Concentration indicates that at which the gMFIr was calculated. Not reliable fit indicates antibody binding characteristics do meet appropriate mathematical fitting requirements. Some antibodies were not tested in some conditions due to poor binding characteristics, specificity, or manufacturability.

FIGS. 32A-32B PVRIG binding characteristics to primary human PBMC, cyno transient over-expressing cells, and cyno primary PBMC. Expi cyno OE denotes expi cells transiently transfected with cPVRIG, expi par denotes expi parental cells. gMFIr indicates the fold difference in geometric MFI of PVRIG antibody staining relative to their controls. Concentration indicates that at which the gMFIr was calculated. Some antibodies were not tested in some conditions due to poor binding characteristics, specificity, or manufacturability as in FIGS. 31A-31B. Additionally, select antibodies were triaged for screening on cyno PBMC subsets based on their ability to bind cPVRIG transient cells or functionality. Expression of PVRIG on CD4 T cells is similar to that described in the table for CD8 T cells.

FIGS. 37A-37B shows the CDR sequences for Fabs that were determined to successfully block interaction of the PVRIG with its counterpart PVRL2, as described in Example 5.

FIGS. 38A-38AA shows the amino acid sequences of the variable heavy and light domains, the full length heavy and light chains, and the variable heavy and variable light CDRs for the enumerated human CPA anti-PVRIG sequences of the invention that both bind PVRIG and block binding of PVRIG and PVLR2.

FIGS. 39A-39H depicts the amino acid sequences of the variable heavy and light domains, the full length heavy and light chains, and the variable heavy and variable light CDRs for eight human CPA anti-PVRIG sequences of the invention that bind PVRIG and but do not block binding of PVRIG and PVLR2.

FIGS. 40A-40D depicts the CDRs for all CPA anti-PVRIG antibody sequences that were generated that bind PVRIG, including those that do not block binding of PVRIG and PVLR2.

FIGS. 41A to 41DD depicts the variable heavy and light chains as well as the vhCDR1, vhCDR2, vhCDR3, vlCDR1, vlCDR2 and vlCDR3 sequences of each of the enumerated CHA antibodies of the invention, CHA.7.502, CHA.7.503, CHA.7.506, CHA.7.508, CHA.7.510, CHA.7.512, CHA.7.514, CHA.7.516, CHA.7.518, CHA.7.520.1, CHA.7.520.2, CHA.7.522, CHA.7.524, CHA.7.526, CHA.7.527, CHA.7.528, CHA.7.530, CHA.7.534, CHA.7.535, CHA.7.537, CHA.7.538.1, CHA.7.538.2, CHA.7.543, CHA.7.544, CHA.7.545, CHA.7.546, CHA.7.547, CHA.7.548, CHA.7.549 and CHA.7.550 (these include the variable heavy and light sequences from mouse sequences (from Hybridomas).

FIG. 42 depicts the binning results from Example 11. Not binned: CPA.7.029 and CPA.7.026 (no binding to the antigen).

FIGS. 45A-45JJ Sensorgrams indicating the antigen blocking pattern for CPA.7.036 with all other immobilized mAbs, which are representative data for Bin #1. Each panel represents a different ProteOn chip array spot having a different immobilized mAb. Blue responses are antigen-only controls. Black responses are pre-mixed solutions of CPA.7.036 in molar excess of antigen. Gray responses are mAb-only control injections. CPA.7.36 blocks antigen binding to all other mAbs except for CPA.7.050 (JJ).

FIGS. 46A-46JJ Sensorgrams indicating the antigen blocking pattern for CPA.7.034 with all other immobilized mAbs, which are representative data for Bin #2. Each panel represents a different ProteOn chip array spot having a different immobilized mAb. Blue responses are antigen-only controls. Black responses are pre-mixed solutions of CPA.7.34 in molar excess of antigen. Gray responses are mAb-only control injections. CPA.7.34 blocks antigen binding to all other mAbs except for CPA.7.039 (DD) and CPA.7.050 (JJ).

FIGS. 47A-47JJ Sensorgrams indicating the antigen blocking pattern for CPA.7.039 with all other immobilized mAbs. CPA.7.039 is the only mAb in Bin #3. Each panel represents a different ProteOn chip array spot having a different immobilized mAb. Blue responses are antigen-only controls. Black responses are pre-mixed solutions of CPA.7.039 in molar excess of antigen. Gray responses are mAb-only control injections. Panels C, F, H, J, L, N, R, S, Z, EE, GG, HH, II, and JJ show sandwiching of the antigen.

FIGS. 48A-48JJ Sensorgrams indicating the antigen blocking pattern for CPA.7.050 with all other immobilized mAbs. CPA.7.050 is the only mAb in Bin #4. Each panel represents a different ProteOn chip array spot having a different immobilized mAb. Blue responses are antigen-only controls. Black responses are pre-mixed solutions of CPA.7.50 in molar excess of antigen. Gray responses are mAb-only control injections. Only panel JJ shows antigen blocking which is where CPA.7.050 was injected w/antigen over itself.

FIG. 49 show the results of the SPR experiments of Example 12.

FIGS. 52A-52B shows the results of the blocking studies from "Additional Validation Study 4" in Example 5.

FIG. 54 shows the human cell lines tested in Example 1G.

FIG. 55 shows the mouse cell lines tested in Example 1G.

FIG. 61 indicates the summary of the findings described in this report, highlighting the cell lines showing correlation between qPCR and FACS, confirmed by knock down, HSKG—housekeeping gene, +—Positive, NT—Not Tested, X—negative, KD—knockdown.

FIG. 62 indicates the summary of the findings described in this report, highlighting the cell lines showing correlation between qPCR and FACS, confirmed by knock down. HSKG—housekeeping gene, +—Positive, NT—Not Tested, X—negative, KD—knockdown.

FIGS. 63A-63D depicts the vhCDR1, vhCDR2, vhCDR3, vlCDR1, vlCDR2 and vlCDR3 sequences of each of the enumerated CPA antibodies of the invention, CPA.7.001 to CPA.7.050 are human sequences (from Phage display).

FIGS. 64A-64B shows the results of the screening in Example 1B.

FIG. 65 Antibodies specifics and staining concentration used in Example 1I.

FIGS. 66A-66C depicts the sequences of human IgG1, IgG2, IgG3 and IgG4.

FIG. 67 depicts a number of human PVRIG ECD fragments.

FIGS. 79A-79B PVRIG hybridoma antibody binding characteristics to HEK hPVRIG engineered cell lines, HEK parental cells, and Jurkat cells. HEK OE denotes HEK hPVRIG cells, HEK par denotes HEK parental cells. For Jurkat data, gMFIr indicates the fold difference in geometric MFI of PVRIG antibody staining relative to their controls. Concentration indicates that at which the gMFIr was calculated. No binding indicates antibody does not bind to the tested cell line. Highlighted antibodies are the 'top four' antibodies of interest.

FIGS. 80A-80B PVRIG hybridoma antibody binding characteristics to primary human PBMC, cyno over-expressing cells, and cyno primary PBMC. Expi cyno OE denotes expi cells transiently transfected with cPVRIG, expi par denotes expi parental cells. gMFIr indicates the fold difference in geometric MFI of PVRIG antibody staining relative to their controls. Concentrations indicate that at which the gMFIr was calculated. Not tested indicates antibodies that were not tested due to an absence of binding to human HEK hPVRIG, expi cPVRIG cells, or not meeting binding requirements to PBMC subsets. Highlighted antibodies are the 'top four' antibodies of interest.

FIGS. 81A-81B Summary of blocking capacity of PVRIG antibodies in the FACS-based competition assay. The $IC_{50}$ of inhibition is indicated. No $IC_{50}$ indicates that these antibodies are non-blockers. Highlighted antibodies are the 'top four' antibodies of interest.

FIGS. 86A-86F MART-1 or 209 TILs were co-cultured with melanoma cells 624 at 1:1 E:T for 18 hr in the presence of anti-PVRIG Ab (CPA.7.021; 10 μg/ml), anti-DNAM1 (DX11 clone; 10 μg/ml) or in in combination. Supernatant was collected and tested in Th1 Th2 Th17 cytometric bead array assay to detect secreted cytokines. IFNγ (A,D) and TNF (B,E) levels were detected. TILs were stained for surface expression of CD137 (C,F).

FIGS. 87A-87B TILs (F4) were co-cultured with melanoma cells 624 at 1:3 E:T for 18 hr in the presence of anti-PVRIG Ab (CPA.7.021; 10 μg/ml), anti-TIGIT (10A7 clone; 10 μg/ml), anti-PD1 (mAb 1B8, Merck; 10 μg/ml) or in combination. Supernatant was collected and tested in Th1 Th2 Th17 cytometric bead array assay to detect secreted cytokines. IFNγ (A) and TNF (B) levels were detected.

FIGS. 88A-88I I depict four humanized sequences for each of CHA.7.518, CHA.7.524, CHA.7.530, CHA.7.538_1 and CHA.7.538_2. Note that the light chain for CHA.7.538_2 is the same as for CHA.7.538_1. The "H1" of each is a "CDR swap" with no changes to the human framework. Subsequent sequences alter framework changes shown in larger bold font. CDR sequences are noted in bold. CDR definitions are AbM from website www.bioinf.org.uk/abs/. Human germline and joining sequences from IMGT® the international ImMunoGeneTics® information system www.imgt.org (founder and director: Marie-Paule Lefranc, Montpellier, France). Residue numbering shown as sequential (seq) or according to Chothia from website www.bioinf.org.uk/abs/ (AbM). "b" notes buried sidechain; "p" notes partially buried; "i" notes sidechain at interface between VH and VL domains. Sequence differences between human and murine germlines noted by asterisk (*). Potential additional mutations in frameworks are noted below sequence. Potential changes in CDR sequences noted below each CDR sequence as noted on the figure (#deamidation substitutions: Q/S/A; these may prevent asparagine (N) deamidation. @ tryptophan oxidation substitutions: Y/F/H; these may prevent tryptophan oxidation; @ methionine oxidation substitutions: L/F/A).

Figure 1:
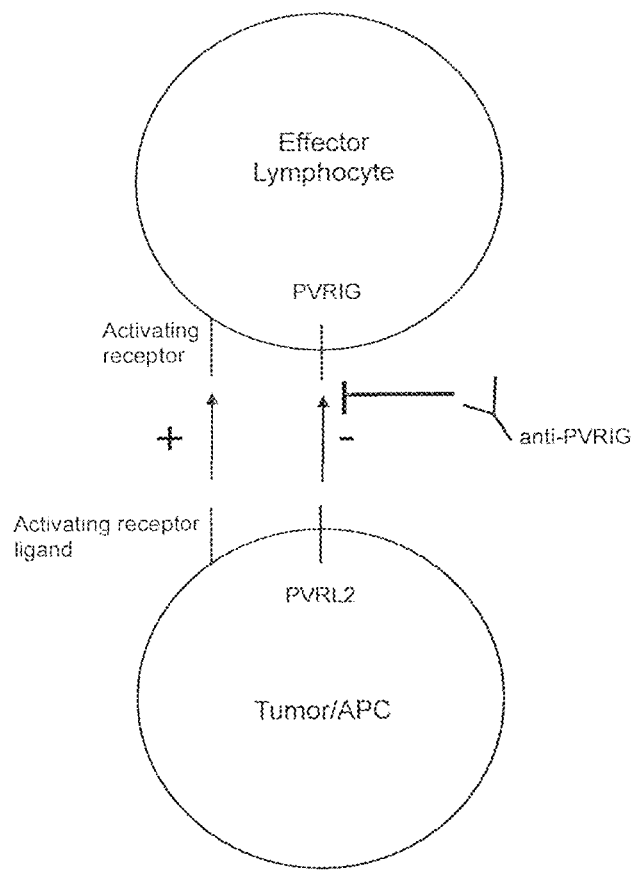
FIG. 1 Schematic presentation of the mechanisms of action of the invention.

FIGS. 89A-89E depicts a collation of the humanized sequences of five CHA antibodies.

FIG. 90 depicts schemes for combining the humanized VH and VL CHA antibodies of FIGS. 88A-88I and FIGS. 89A-89E. The "chimVH" and "chimVL" are the mouse variable heavy and light sequences attached to a human IgG constant domain.

FIG. 91 PVRIG hybridoma antibody binding characteristics to primary human PBMC, cyno over-expressing cells, and cyno primary PBMC. Expi cyno OE denotes expi cells transiently transfected with cPVRIG, expi par denotes expi parental cells. gMFIr indicates the fold difference in geometric MFI of PVRIG antibody staining relative to their controls. Concentrations indicate that at which the gMFIr was calculated. Not tested indicates antibodies that were not tested due to an absence of binding to human HEK hPVRIG, expi cPVRIG cells, or not meeting binding requirements to PBMC subsets. Highlighted antibodies are four antibodies for which humanization was done (See FIG. 90).

FIG. 92 Summary of blocking capacity of PVRIG antibodies in the FACS-based competition assay. The IC50 of inhibition is indicated. No IC50 indicates that these antibodies are non-blockers. Highlighted antibodies are four antibodies for which humanization was done (See FIG. 90).

FIGS. 93A-93C Effect of PVRIG antibodies in blocking the interaction between PVRIG and PVRL2. (a-b) Data shows changes in absolute gMFI representing changes in binding of soluble PVRIG to HEK cells when four PVRIG antibodies are added to disrupt the interaction. Also indicated are the $IC_{50}$ values of each antibody in each assay. A) Data shows disruption of soluble PVRIG with HEK cells when the antibodies are pre-incubated with antigen. B) Data shows disruption of soluble PVRIG with HEK cells when the antibodies are added concomitantly with antigen. C) Data shows changes in absolute gMFI representing changes in binding of soluble PVRL2 Fc to HEK hPVRIG cells when four PVRIG antibodies are added to disrupt the interaction. $IC_{50}$ values of each antibody are indicated. ND denotes not determined.

FIGS. 94A-94H NK cell receptor and ligand expression on Reh cells. Expression of NK cell receptors such as a) PVRIG, b) DNAM-1, c) TIGIT are shown. Expression of NK receptor ligands such as d) PVR, e) PVRL2, f) ULBP2/5/6, g) ULBP3, and h) MICA/B are shown. Solid grey histograms represent isotype controls and open black histograms represent the antibody of interest.

FIGS. 95A-95F Effect of PVRIG antibodies on enhancing NK cell-mediated cytotoxicity against Reh cells. The effect of 5 µg/ml CPA.7.002 (a), CPA.7.005 (b), CPA.7.021 (a-c), and CPA.7.050 (c) was examined in NK cell cytotoxicity assays against Reh cells where the number of NK cells was titrated against a constant number of Reh cells. d) The effect of varying the concentration of CPA.7.002 and CPA.7.021 on NK cell-mediated cytotoxicity with a constant number of NK to Reh cells (5:1) was examined. DNAM-1 (e) and TIGIT (f) were examined in assays with conditions as outlined in panels a-c.

FIGS. 96A-96H NK cell receptor and ligand expression on MOLM-13 cells. Expression of NK cell receptors such as a) PVRIG, b) DNAM-1, c) TIGIT are shown. Expression of NK receptor ligands such as d) PVR, e) PVRL2, f) ULBP2/5/6, g) ULBP3, and h) MICA/B are shown. Solid grey histograms represent isotype controls and open black histograms represent the antibody of interest.

FIGS. 97A-97B Effect of PVRIG antibodies on enhancing NK cell-mediated cytotoxicity against MOLM-13 cells. a) The effect of 5 µg/ml CPA.7.002, CPA.7.005, and CPA.7.021 was examined in NK cell cytotoxicity assays against MOLM-13 cells where the number of NK cells was titrated against a constant number of MOLM-13 cells. b) TIGIT was examined similar to panel a.

FIG. 98 Summary of blocking capacity of PVRIG antibodies in the cellular biochemical assay. Assay permutation and orientation, and the $IC_{50}$ of inhibition are indicated. (P) indicates the assay permutation where PVRIG antibodies are pre-incubated with PVRIG antigen prior to addition to HEK cells. (NP) indicates the concomitant addition of PVRIG antibodies and PVRIG antigen to HEK cells. Increased binding indicates that PVRL2 Fc binding to HEK hPVRIG cells was enhanced, rather than inhibited.

FIG. 99: Summary of the activity of select PVRIG antibodies in NK cell cytotoxicity assays against Reh and MOLM-13 cells. Fold change in cytotoxicity relative to control was calculated by dividing the absolute level of killing (%) in the condition with PVRIG antibody, by the absolute level of killing (%) with control antibody. Fold change is calculated from the 5:1 effector to target ratio.

FIG. 100 Sequence alignment of PVRIG orthologs. Aligned sequences of the human, cynomolgus, marmoset, and rhesus PVRIG extra-cellular domain. The differences between human and cynomolgus are highlighted in yellow.

FIG. 101 Binding of anti human PVRIG antibodies to cyno, human, cyno/human hybrid PVRIG variants. Binding of antibodies to wild type cyno PVRIG (●), H61R cyno PVRIG (■), P67S cyno PVRIG (▲), L95R/T97I cyno PVRIG (▼), and wild type human PVRIG (♦) are shown. The ELISA signals are plotted as a function of antibody concentration.

FIG. 102 Correlation of epitope group and cyno cross-reactivity of anti-human PVRIG antibodies.

FIGS. 103A-103BX shows a number of sequences of use in the invention.

DETAILED DESCRIPTION OF THE INVENTION

I. Introduction

Cancer can be considered as an inability of the patient to recognize and eliminate cancerous cells. In many instances, these transformed (e.g. cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells—especially T cells—to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy, Keytruda and Opdivo. These antibodies are generally referred to as "checkpoint inhibitors" because they block normally negative regulators of T cell immunity. It is generally understood that a variety of immunomodulatory signals, both costimulatory and coinhibitory, can be used to orchestrate an optimal antigen-specific immune response. Generally, these antibodies bind to checkpoint inhibitor proteins such as CTLA-4 and PD-1, which under normal circumstances prevent or suppress activation of cytotoxic T cells (CTLs). By inhibiting the checkpoint protein, for example through the use of antibodies that bind these proteins, an increased T cell response against tumors can be achieved. That is, these cancer checkpoint proteins suppress the immune response; when the proteins are blocked, for example using antibodies to the checkpoint protein, the immune system is activated, leading to immune stimulation, resulting in treatment of conditions such as cancer and infectious disease.

The present invention is directed to the use of antibodies to human Poliovirus Receptor Related Immunoglobulin Domain Containing Protein, or "PVRIG", sometimes also referred to herein as "PV protein". PVRIG is expressed on the cell surface of NK and T-cells and shares several similarities to other known immune checkpoints.

Computational algorithms were used to analyze the human genome in order to identify novel immune checkpoints. Genes were identified that are predicted to be cell surface proteins, have an Ig domain and are expressed on immune cells within the tumor microenvironment, specifically on tumor infiltrating lymphocytes (TILs), which are presumed to be receptors. Proteins that have a single IgV domain and have an intracellular ITIM-like motif were identified, which suggests that they are acting as immune checkpoint and have an inhibitory effect on T cells and/or NK cells. Once identified computationally, various validation experiments were done, including: expression studies demonstrating that PVRIG is expressed on lymphocytes and on lymphocytes within the tumor microenvironment and has an inhibitory effect on NK and T cells (demonstrated both with knockdown experiments and with antibodies directed at PVRIG). PVRL2 was identified/confirmed to be the counterpart of PVRIG. Antibodies that bind to PVRIG were generated, and then a subset of those were identified that both bind to PVRIG and block the interaction of PVRIG and PVLR2.

Accordingly, when PVRIG is bound by its ligand (PVRL2), an inhibitory signal is elicited which acts to attenuate the immune response of NK and T-cells against a target cell (i.e. analogous to PD-1/PDL1). Blocking the binding of PVRL2 to PVRIG shuts-off this inhibitory signal of PVRIG and as a result modulates the immune response of NK and T-cells. Utilizing an antibody against PVRIG that blocks binding to PVRL2 is a therapeutic approach that could enhance the killing of cancer cells by NK and T-cells. Blocking antibodies have been generated which bind PVRIG and block the binding of its ligand, PVRL2.

As shown in the Example section, the expression of PVRIG has been positively correlated to expression of PD-1, a known immune checkpoint protein. Additionally, introduction of PVRIG (as a extracellular domain (ECD) fusion protein) was shown to inhibit the activation of T cells, and thus the use of anti-PVRIG antibodies leads to T cell activation. Accordingly, anti-PVRIG antibodies can be used to treat conditions for which T cell or NK cell activation is desired such as cancer.

Functional effects of PVRIG blocking antibodies on NK and T-cells can be assessed in vitro (and in some cases in vivo, as described more fully below) by measuring changes in the following parameters: proliferation, cytokine release and cell-surface makers. For NK cells, increases in cell proliferation, cytotoxicity (ability to kill target cells as measured by increases in CD107a, granzyme, and perforin expression, or by directly measuring target cells killing), cytokine production (e.g. IFN-γ and TNF), and cell surface receptor expression (e.g. CD25) is indicative of immune modulation, e.g. enhanced killing of cancer cells. For T-cells, increases in proliferation, increases in expression of cell surface markers of activation (e.g. CD25, CD69, CD137, and PD1), cytotoxicity (ability to kill target cells), and cytokine production (e.g. IL-2, IL-4, IL-6, IFNγ, TNF-α, IL-10, IL-17A) are indicative of immune modulation, e.g. enhanced killing of cancer cells.

Accordingly, the present invention provides antibodies, including antigen binding domains, that bind to human PVRIG pps and methods of activating T cells and/or NK cells to treat diseases such as cancer and infectious diseases, and other conditions where increased immune activity results in treatment.

II. PVRIG Proteins

The present invention provides antibodies that specifically bind to PVRIG proteins. "Protein" in this context is used interchangeably with "polypeptide", and includes peptides as well. The present invention provides antibodies that specifically bind to PVRIG proteins. PVRIG is a transmembrane domain protein of 326 amino acids in length, with a signal peptide (spanning from amino acid 1 to 40), an extracellular domain (spanning from amino acid 41 to 171), a transmembrane domain (spanning from amino acid 172 to 190) and a cytoplasmic domain (spanning from amino acid 191 to 326). The full length human PVRIG protein is shown in FIG. 25. There are two methionines that can be start codons, but the mature proteins are identical.

Accordingly, as used herein, the term "PVRIG" or "PVRIG protein" or "PVRIG polypeptide" may optionally include any such protein, or variants, conjugates, or fragments thereof, including but not limited to known or wild type PVRIG, as described herein, as well as any naturally occurring splice variants, amino acid variants or isoforms, and in particular the ECD fragment of PVRIG. The term "soluble" form of PVRIG is also used interchangeably with the terms "soluble ectodomain (ECD)" or "ectodomain" or "extracellular domain (ECD) as well as "fragments of PVRIG polypeptides", which may refer broadly to one or more of the following optional polypeptides:

The PVRIG proteins contain an immunoglobulin (Ig) domain within the extracellular domain, which is a PVR-like Ig fold domain. The PVR-like Ig fold domain may be responsible for functional counterpart binding, by analogy to the other B7 family members. The PVR-like Ig fold domain of the extracellular domain includes one disulfide bond formed between intra domain cysteine residues, as is typical for this fold and may be important for structure-function. These cysteines are located at residues 22 and 93 (or 94). In one embodiment, there is provided a soluble fragment of PVRIG that can be used in testing of PVRIG antibodies.

Included within the definition of PVRIG proteins are PVRIG ECD fragments. Optionally, the PVRIG ECD fragments refer also to any one of the polypeptide sequences listed in FIG. 67, which are reasonably expected to comprise functional regions of the PVRIG protein. This expectation is based on a systematic analysis of a set of protein complexes with solved 3D structures, which contained complexes of Ig proteins (for example PDB ID 1i85 which describe the complex of CTLA4 AND CD86). The intermolecular contact residues from each "co-structure" from each PDB were collected and projected on the sequence of PVRIG. Several regions with clusters of interacting residues supported by several contact maps were identified and synthesized as a series of peptides and are reasonably expected to mimic the structure of the intact full length protein and thereby modulate one or more of the effects of PVRIG on immunity and on specific immune cell types. According to at least some embodiments of the invention, the PVRIG ECD fragments represented by polypeptide sequences listed in FIG. 67, are located as follows (as compared to human PVRIG ECD of FIG. 25, counting from the first amino acid of the ECD):

PVRIG Fragment A is located at positions 46 to 66; PVRIG Fragment B is located at positions 46 to 79; PVRIG Fragment C is located at positions 63 to 79; PVRIG Fragment D is located at positions 91 to 106; PVRIG Fragment E is located at positions 91 to 114; PVRIG Fragment F is located at positions 11 to 25; PVRIG Fragment G is located at positions 3 to 24; PVRIG Fragment H is located at positions 18 to 36; PVRIG Fragment I is located at positions 29 to 52; PVRIG Fragment J is located at positions 73-98.

As noted herein and more fully described below, anti-PVRIG antibodies (including antigen-binding fragments) that both bind to PVRIG and prevent activation by PVRL2 (e.g. most commonly by blocking the interaction of PVRIG and PVLR2), are used to enhance T cell and/or NK cell activation and be used in treating diseases such as cancer and pathogen infection.

III. Antibodies

Accordingly, the invention provides anti-PVRIG antibodies. PVRIG, also called Poliovirus Receptor Related Immunoglobulin Domain Containing Protein, Q6DK17 or C7orf15, relates to amino acid and nucleic acid sequences shown in RefSeq accession identifier NP_076975, shown in FIG. 25. The antibodies of the invention are specific for the PVRIG extracellular domain as more fully outlined herein.

As is discussed below, the term "antibody" is used generally. Antibodies that find use in the present invention can take on a number of formats as described herein, including traditional antibodies as well as antibody derivatives, fragments and mimetics, described below. In general, the term "antibody" includes any polypeptide that includes at least one antigen binding domain, as more fully described below. Antibodies may be polyclonal, monoclonal, xenogeneic, allogeneic, syngeneic, or modified forms thereof, as described herein, with monoclonal antibodies finding particular use in many embodiments. In some embodiments, antibodies of the invention bind specifically or substantially specifically to PVRIG molecules. The terms "monoclonal antibodies" and "monoclonal antibody composition", as used herein, refer to a population of antibody molecules that contain only one species of an antigen-binding site capable of immunoreacting with a particular epitope of an antigen, whereas the term "polyclonal antibodies" and "polyclonal antibody composition" refer to a population of antibody molecules that contain multiple species of antigen-binding sites capable of interacting with a particular antigen. A monoclonal antibody composition, typically displays a single binding affinity for a particular antigen with which it immunoreacts.

Traditional full length antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several sub-classes, including, but not limited to IgG1, IgG2, IgG3, and IgG4. Thus, "isotype" as used herein is meant any of the subclasses of immunoglobulins defined by the chemical and antigenic characteristics of their constant regions. While the exemplary antibodies herein designated "CPA" are based on IgG1 heavy constant regions, as shown in FIGS. 38A-38AA, the anti-PVRIG antibodies of the invention include those using IgG2, IgG3 and IgG4 sequences, or combinations thereof. For example, as is known in the art, different IgG isotypes have different effector functions which may or may not be desirable. Accordingly, the CPA antibodies of the invention can also swap out the IgG1 constant domains for IgG2, IgG3 or IgG4 constant domains (depicted in FIGS. 66A-66C), with IgG2 and IgG4 finding particular use in a number of situations, for example for ease of manufacture or when reduced effector function is desired, the latter being desired in some situations.

For the enumerated antibodies of the CHA designation, these are murine antibodies generated in hybridomas (the "H" designation), and thus in general they are humanized as is known in the art, generally in the framework regions (F1 to F4 for each of the heavy and light variable regions), and then grafted onto human IgG1, IgG2, IgG3 or IgG4 constant heavy and light domains (depicted in FIGS. 66A-66C), again with IgG4 finding particular use, as is more fully described below.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions".

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region, although sometimes the numbering is shifted slightly as will be appreciated by those in the art; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below and shown in FIGS. 40A-40D.

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat.

Accordingly, the invention provides variable heavy domains, variable light domains, heavy constant domains, light constant domains and Fc domains to be used as outlined herein. By "variable region" as used herein is meant the region of an immunoglobulin that comprises one or more Ig domains substantially encoded by any of the $V_\kappa$ or $V\lambda$, and/or VH genes that make up the kappa, lambda, and heavy chain immunoglobulin genetic loci respectively. Accordingly, the variable heavy domain comprises vhFR1-vh-CDR1-vhFR2-vhCDR2-vhFR3-vhCDR3-vhFR4, and the variable light domain comprises vlFR1-vlCDR1-v1FR2-vlCDR2-vlFR3-vlCDR3-vlFR4. By "heavy constant region" herein is meant the CH1-hinge-CH2-CH3 portion of an antibody. By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains C$\gamma$2 and C$\gamma$3 (C$\gamma$2 and C$\gamma$3) and the lower hinge region between C$\gamma$1 (C$\gamma$1) and C$\gamma$2 (C$\gamma$2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more Fc$\gamma$R receptors or to the FcRn receptor.

Thus, "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody. As will be appreciated by those in the art, these generally are made up of two chains.

Throughout the present specification, either the IMTG numbering system or the Kabat numbering system is generally used when referring to a residue in the variable domain (approximately, residues 1-107 of the light chain variable region and residues 1-113 of the heavy chain variable region) (e.g., Kabat et al., supra (1991)). EU numbering as in Kabat is generally used for constant domains and/or the Fc domains.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning". Specific bins are described below.

Included within the definition of "antibody" is an "antigen-binding portion" of an antibody (also used interchangeably with "antigen-binding fragment", "antibody fragment" and "antibody derivative"). That is, for the purposes of the invention, an antibody of the invention has a minimum functional requirement that it bind to a PVRIG antigen. As will be appreciated by those in the art, there are a large number of antigen fragments and derivatives that retain the ability to bind an antigen and yet have alternative structures, including, but not limited to, (i) the Fab fragment consisting of VL, VH, CL and CH1 domains, (ii) the Fd fragment consisting of the VH and CH1 domains, (iii) F(ab')2 fragments, a bivalent fragment comprising two linked Fab fragments (vii) single chain Fv molecules (scFv), wherein a VH domain and a VL domain are linked by a peptide linker which allows the two domains to associate to form an antigen binding site (Bird et al., 1988, Science 242:423-426, Huston et al., 1988, Proc. Natl. Acad. Sci. U.S.A. 85:5879-5883, entirely incorporated by reference), (iv) "diabodies" or "triabodies", multivalent or multispecific fragments constructed by gene fusion (Tomlinson et. al., 2000, Methods Enzymol. 326:461-479; WO94/13804; Holliger et al., 1993, Proc. Natl. Acad. Sci. U.S.A. 90:6444-6448, all entirely incorporated by reference), (v) "domain antibodies" or "dAb" (sometimes referred to as an "immunoglobulin single variable domain", including single antibody variable domains from other species such as rodent (for example, as disclosed in WO 00/29004), nurse shark and Camelid V-HH dAbs, (vi) SMIPs (small molecule immunopharmaceuticals), camelbodies, nanobodies and IgNAR.

Still further, an antibody or antigen-binding portion thereof (antigen-binding fragment, antibody fragment, antibody portion) may be part of a larger immunoadhesion molecules (sometimes also referred to as "fusion proteins"), formed by covalent or noncovalent association of the antibody or antibody portion with one or more other proteins or peptides. Examples of immunoadhesion molecules include use of the streptavidin core region to make a tetrameric scFv molecule and use of a cysteine residue, a marker peptide and a C-terminal polyhistidine tag to make bivalent and biotinylated scFv molecules. Antibody portions, such as Fab and F(ab')$_2$ fragments, can be prepared from whole antibodies using conventional techniques, such as papain or pepsin digestion, respectively, of whole antibodies. Moreover, antibodies, antibody portions and immunoadhesion molecules can be obtained using standard recombinant DNA techniques, as described herein.

In general, the anti-PVRIG antibodies of the invention are recombinant. "Recombinant" as used herein, refers broadly with reference to a product, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (non-recombinant) form of the cell or express native genes that are otherwise abnormally expressed, under expressed or not expressed at all.

The term "recombinant antibody", as used herein, includes all antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom (described further below), (b) antibodies isolated from a host cell transformed to express the human antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies have variable regions in which the framework and CDR regions are derived from human germline immunoglobulin sequences. In certain embodiments, however, such recombinant human antibodies can be subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

A. Optional Antibody Engineering

The antibodies of the invention can be modified, or engineered, to alter the amino acid sequences by amino acid substitutions.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

As discussed herein, amino acid substitutions can be made to alter the affinity of the CDRs for the PVRIG protein (including both increasing and decreasing binding, as is more fully outlined below), as well as to alter additional functional properties of the antibodies. For example, the antibodies may be engineered to include modifications within the Fc region, typically to alter one or more functional properties of the antibody, such as serum half-life, complement fixation, Fc receptor binding, and/or antigen-dependent cellular cytotoxicity. Furthermore, an antibody according to at least some embodiments of the invention may be chemically modified (e.g., one or more chemical moieties can be attached to the antibody) or be modified to alter its glycosylation, again to alter one or more functional properties of the antibody. Such embodiments are described further below. The numbering of residues in the Fc region is that of the EU index of Kabat.

In one embodiment, the hinge region of $C_{H1}$ is modified such that the number of cysteine residues in the hinge region is altered, e.g., increased or decreased. This approach is described further in U.S. Pat. No. 5,677,425 by Bodmer et al. The number of cysteine residues in the hinge region of CH1 is altered to, for example, facilitate assembly of the light and heavy chains or to increase or decrease the stability of the antibody.

In another embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired *Staphylococcyl* protein A (SpA) binding relative to native Fc-hinge domain SpA binding. This approach is described in further detail in U.S. Pat. No. 6,165,745 by Ward et al.

In some embodiments, amino acid substitutions can be made in the Fc region, in general for altering binding to FcγR receptors. By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII-1 (CD16), and FcγRIII-2 (CD16-2), as well as any undiscovered mouse FcγRs or FcγR isoforms or allotypes.

There are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell. Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41) and U.S. Pat. No. 6,737,056, both of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 299T and 297N.

In addition, the antibodies of the invention are modified to increase its biological half-life. Various approaches are possible. For example, one or more of the following mutations can be introduced: T252L, T254S, T256F, as described in U.S. Pat. No. 6,277,375 to Ward. Alternatively, to increase the biological half-life, the antibody can be altered within the $C_{H1}$ or $C_L$ region to contain a salvage receptor binding epitope taken from two loops of a CH2 domain of an Fc region of an IgG, as described in U.S. Pat. Nos. 5,869,046 and 6,121,022 by Presta et al. Additional mutations to increase serum half life are disclosed in U.S. Pat. Nos. 8,883,973, 6,737,056 and 7,371,826, and include 428L, 434A, 434S, and 428L/434S.

In yet other embodiments, the Fc region is altered by replacing at least one amino acid residue with a different amino acid residue to alter the effector functions of the antibody. For example, one or more amino acids selected from amino acid residues 234, 235, 236, 237, 297, 318, 320 and 322 can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260, both by Winter et al.

In another example, one or more amino acids selected from amino acid residues 329, 331 and 322 can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region is modified to increase the ability of the antibody to mediate antibody dependent cellular cytotoxicity (ADCC) and/or to increase the affinity of the antibody for an Fcγ receptor by modifying one or more amino acids at the following positions: 238, 239, 248, 249, 252, 254, 255, 256, 258, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 333, 334, 335, 337, 338, 340, 360, 373, 376, 378, 382, 388, 389, 398, 414, 416, 419, 430, 434, 435, 437, 438 or 439. This approach is described further in PCT Publication WO 00/42072 by Presta. Moreover, the binding sites on human IgG1 for Fc ɣRI, Fc ɣRII, Fc ɣRIII and FcRn have been mapped and variants with improved binding have been described (see Shields, R. L. et al. (2001) *J. Biol. Chem.* 276:6591-6604). Specific mutations at positions 256, 290, 298, 333, 334 and 339 are shown to improve binding to FcγRIII. Additionally, the following combination mutants are shown to improve Fc ɣRIII binding: T256A/S298A, S298A/E333A, S298A/K224A and S298A/E333A/K334A. Furthermore, mutations such as M252Y/S254T/T256E or M428L/N434S improve binding to FcRn and increase antibody circulation half-life (see Chan C A and Carter P J (2010) *Nature Rev Immunol* 10:301-316).

In still another embodiment, the antibody can be modified to abrogate in vivo Fab arm exchange. Specifically, this process involves the exchange of IgG4 half-molecules (one heavy chain plus one light chain) between other IgG4 antibodies that effectively results in bispecific antibodies which are functionally monovalent. Mutations to the hinge region and constant domains of the heavy chain can abrogate this exchange (see Aalberse, R C, Schuurman J., 2002, *Immunology* 105:9-19).

In still another embodiment, the glycosylation of an antibody is modified. For example, an aglycosylated antibody can be made (i.e., the antibody lacks glycosylation). Glycosylation can be altered to, for example, increase the affinity of the antibody for antigen or reduce effector function such as ADCC. Such carbohydrate modifications can be accomplished by, for example, altering one or more sites of glycosylation within the antibody sequence, for example N297. For example, one or more amino acid substitutions can be made that result in elimination of one or more variable region framework glycosylation sites to thereby eliminate glycosylation at that site.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies according to at least some embodiments of the invention to thereby produce an antibody with altered glycosylation. For example, the cell lines Ms704, Ms705, and Ms709 lack the fucosyltransferase gene, FUT8 (α(1,6) fucosyltransferase), such that antibodies expressed in the Ms704, Ms705, and Ms709 cell lines lack fucose on their carbohydrates. The Ms704, Ms705, and Ms709 FUT8 cell lines are created by the targeted disruption of the FUT8 gene in CHO/DG44 cells using two replacement vectors (see U.S. Patent Publication No. 20040110704 by Yamane et al. and Yamane-Ohnuki et al. (2004) *Biotechnol Bioeng* 87:614-22). As another example, EP 1,176,195 by Hanai et al. describes a cell line with a functionally disrupted FUT8 gene, which encodes a fucosyl transferase, such that antibodies expressed in such a cell line exhibit hypofucosylation by reducing or eliminating the α 1,6 bond-related enzyme. Hanai et al. also describe cell lines which have a low enzyme activity for adding fucose to the N-acetylglucosamine that binds to the Fc region of the antibody or does not have the enzyme activity, for example the rat myeloma cell line YB2/0 (ATCC CRL 1662). PCT Publication WO 03/035835 by Presta describes a variant CHO cell line, Lec13 cells, with reduced ability to attach fucose to Asn(297)-linked carbohydrates, also resulting in hypofucosylation of antibodies expressed in that host cell (see also Shields, R. L. et al. (2002) *J. Biol. Chem.* 277:26733-26740). PCT Publication WO 99/54342 by Umana et al. describes cell lines engineered to express glycoprotein-modifying glycosyl transferases (e.g., β(1,4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) *Nat. Biotech.* 17:176-180). Alternatively, the fucose residues of the antibody may be cleaved off using a fucosidase enzyme. For example, the fucosidase a-L-fucosidase removes fucosyl residues from antibodies (Tarentino, A. L. et al. (1975) *Biochem.* 14:5516-23).

Another modification of the antibodies herein that is contemplated by the invention is pegylation or the addition of other water soluble moieties, typically polymers, e.g., in order to enhance half-life. An antibody can be pegylated to, for example, increase the biological (e.g., serum) half-life of the antibody. To pegylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono ($C_1$-$C_{10}$) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies according to at least some embodiments of the invention. See for example, EP 0 154 316 by Nishimura et al. and EP 0 401 384 by Ishikawa et al.

In addition to substitutions made to alter binding affinity to FcγRs and/or FcRn and/or increase in vivo serum half life, additional antibody modifications can be made, as described in further detail below.

In some cases, affinity maturation is done. Amino acid modifications in the CDRs are sometimes referred to as "affinity maturation". An "affinity matured" antibody is one having one or more alteration(s) in one or more CDRs which results in an improvement in the affinity of the antibody for antigen, compared to a parent antibody which does not possess those alteration(s). In some cases, although rare, it may be desirable to decrease the affinity of an antibody to its antigen, but this is generally not preferred.

In some embodiments, one or more amino acid modifications are made in one or more of the CDRs of the VISG1 antibodies of the invention. In general, only 1 or 2 or 3-amino acids are substituted in any single CDR, and generally no more than from 1, 2, 3. 4, 5, 6, 7, 8 9 or 10 changes are made within a set of CDRs. However, it should be appreciated that any combination of no substitutions, 1, 2 or 3 substitutions in any CDR can be independently and optionally combined with any other substitution.

Affinity maturation can be done to increase the binding affinity of the antibody for the PVRIG antigen by at least about 10% to 50-100-150% or more, or from 1 to 5 fold as compared to the "parent" antibody. Preferred affinity matured antibodies will have nanomolar or even picomolar affinities for the PVRIG antigen. Affinity matured antibodies are produced by known procedures. See, for example, Marks et al., 1992, Biotechnology 10:779-783 that describes affinity maturation by variable heavy chain (VH) and variable light chain (VL) domain shuffling. Random mutagenesis of CDR and/or framework residues is described in: Barbas, et al. 1994, Proc. Nat. Acad. Sci, USA 91:3809-3813; Shier et al., 1995, Gene 169:147-155; Yelton et al., 1995, J. Immunol. 155:1994-2004; Jackson et al., 1995, J. Immunol. 154(7):3310-9; and Hawkins et al, 1992, J. Mol. Biol. 226:889-896, for example.

Alternatively, amino acid modifications can be made in one or more of the CDRs of the antibodies of the invention that are "silent", e.g. that do not significantly alter the affinity of the antibody for the antigen. These can be made for a number of reasons, including optimizing expression (as can be done for the nucleic acids encoding the antibodies of the invention).

Thus, included within the definition of the CDRs and antibodies of the invention are variant CDRs and antibodies; that is, the antibodies of the invention can include amino acid modifications in one or more of the CDRs of the enumerated antibodies of the invention. In addition, as outlined below, amino acid modifications can also independently and optionally be made in any region outside the CDRs, including framework and constant regions.

IV. PVRIG Antibodies

The present invention provides anti-PVRIG antibodies. (For convenience, "anti-PVRIG antibodies" and "PVRIG antibodies" are used interchangeably). The anti-PVRIG antibodies of the invention specifically bind to human PVRIG, and preferably the ECD of human VISG1, as depicted in FIG. 25.

Specific binding for PVRIG or a PVRIG epitope can be exhibited, for example, by an antibody having a KD of at least about $10^{-4}$M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the PVRIG antigen or epitope.

However, as shown in the Examples, for optimal binding to PVRIG expressed on the surface of NK and T-cells, the antibodies preferably have a KD less 50 nM and most preferably less than 1 nM, with less than 0.1 nM and less than 1 pM and 0.1 pM finding use in the methods of the invention.

Also, specific binding for a particular antigen or an epitope can be exhibited, for example, by an antibody having a KA or Ka for a PVRIG antigen or epitope of at least 20-, 50-, 100-, 500-, 1000-, 5,000-, 10,000- or more times greater for the epitope relative to a control, where KA or Ka refers to an association rate of a particular antibody-antigen interaction.

In some embodiments, the anti-PVRIG antibodies of the invention bind to human PVRIG with a $K_D$ of 100 nM or less, 50 nM or less, 10 nM or less, or 1 nM or less (that is, higher binding affinity), or 1 pM or less, wherein $K_D$ is determined by known methods, e.g. surface plasmon resonance (SPR, e.g. Biacore assays), ELISA, KINEXA, and most typically SPR at 25° or 37° C.

A. Specific Anti-PVRIG Antibodies

The invention provides antigen binding domains, including full length antibodies, which contain a number of specific, enumerated sets of 6 CDRs.

The antibodies described herein as labeled as follows. The antibodies have reference numbers, for example "CPA.7.013". This represents the combination of the variable heavy and variable light chains, as depicted in FIGS. 38A-38AA and FIGS. 39A-39H for example. "CPA.7.013.VH" refers to the variable heavy portion of CPA.7.013, while "CPA.7.013.VL" is the variable light chain. "CPA.7.013.vhCDR1", "CPA.7.013.vhCDR2", "CPA.7.013.vhCDR3", "CPA.7.013.vlCDR1", "CPA.7.013.vlCDR2", and "CPA.7.013.vlCDR3", refers to the CDRs are indicated. "CPA.7.013.HC" refers to the entire heavy chain (e.g. variable and constant domain) of this molecule, and "CPA.7.013.LC" refers to the entire light light chain (e.g. variable and constant domain) of the same molecule. "CPA.7.013.H1" refers to a full length antibody comprising the variable heavy and light domains, including the constant domain of Human IgG1 (hence, the H1; IgG1, IgG2, IgG3 and IgG4 sequences are shown in FIGS. 66A-66C). Accordingly, "CPA.7.013.H2" would be the CPA.7.013 variable domains linked to a Human IgG2. "CPA.7.013.H3" would be the CPA.7.013 variable domains linked to a Human IgG3, and "CPA.7.013.H4" would be the CPA.7.013 variable domains linked to a Human IgG4.

The invention further provides variable heavy and light domains as well as full length heavy and light chains.

In many embodiments, the antibodies of the invention are human (derived from phage) and block binding of PVRIG and PVLR2. As shown in FIGS. 52A-52B, the CPA antibodies that both bind and block the receptor-ligand interaction are as below, with their components outlined as well:

CPA.7.001, CPA.7.001.VH, CPA.7.001.VL, CPA.7.001.HC, CPA.7.001.LC and CPA.7.001.H1, CPA.7.001.H2, CPA.7.001.H3, CPA.7.001.H4; CPA.7.001.vhCDR1, CPA.7.001.vhCDR2, CPA.7.001.vhCDR3, CPA.7.001.vlCDR1, CPA.7.001.vlCDR2, and CPA.7.001.vlCDR3;

CPA.7.003, CPA.7.003.VH, CPA.7.003.VL, CPA.7.003.HC, CPA.7.003.LC, CPA.7.003.H1, CPA.7.003.H2, CPA.7.003.H3, CPA.7.003.H4; CPA.7.003.vhCDR1, CPA.7.003.vhCDR2, CPA.7.003.vhCDR3, CPA.7.003.vlCDR1, CPA.7.003.vlCDR2, and CPA.7.003.vlCDR3;

CPA.7.004, CPA.7.004.VH, CPA.7.004.VL, CPA.7.004.HC, CPA.7.004.LC, CPA.7.004.H1, CPA.7.004.H2, CPA.7.004.H3 CPA.7.004.H4; CPA.7.004.vhCDR1, CPA.7.004.vhCDR2, CPA.7.004.vhCDR3, CPA.7.004.vlCDR1, CPA.7.004.vlCDR2, and CPA.7.004.vlCDR3;

CPA.7.006, CPA.7.006.VH, CPA.7.006.VL, CPA.7.006.HC, CPA.7.006.LC, CPA.7.006.H1, CPA.7.006.H2, CPA.7.006.H3 CPA.7.006.H4; CPA.7.006.vhCDR1, CPA.7.006.vhCDR2, CPA.7.006.vhCDR3, CPA.7.006.vlCDR1, CPA.7.006.vlCDR2, and CPA.7.006.vlCDR3;

CPA.7.008, CPA.7.008.VH, CPA.7.008.VL, CPA.7.008.HC, CPA.7.008.LC, CPA.7.008.H1, CPA.7.008.H2, CPA.7.008.H3 CPA.7.008.H4; CPA.7.008.vhCDR1, CPA.7.008.vhCDR2, CPA.7.008.vhCDR3, CPA.7.008.vlCDR1, CPA.7.008.vlCDR2, and CPA.7.008.vlCDR3;

CPA.7.009, CPA.7.009.VH, CPA.7.009.VL, CPA.7.009.HC, CPA.7.009.LC, CPA.7.009.H1, CPA.7.009.H2, CPA.7.009.H3 CPA.7.009.H4; CPA.7.009.vhCDR1, CPA.7.009.vhCDR2, CPA.7.009.vhCDR3, CPA.7.009.vlCDR1, CPA.7.009.vlCDR2, and CPA.7.009.vlCDR3;

CPA.7.010, CPA.7.010.VH, CPA.7.010.VL, CPA.7.010.HC, CPA.7.010.LC, CPA.7.010.H1, CPA.7.010.H2, CPA.7.010.H3 CPA.7.010.H4; CPA.7.010.vhCDR1, CPA.7.010.vhCDR2, CPA.7.010.vhCDR3, CPA.7.010.vlCDR1, CPA.7.010.vlCDR2, and CPA.7.010.vlCDR3;

CPA.7.011, CPA.7.011.VH, CPA.7.011.VL, CPA.7.011.HC, CPA.7.011.LC, CPA.7.011.H1, CPA.7.011.H2, CPA.7.011.H3 CPA.7.011.H4; CPA.7.011.vhCDR1, CPA.7.011.vhCDR2, CPA.7.011.vhCDR3, CPA.7.011.vlCDR1, CPA.7.011.vlCDR2, and CPA.7.011.vlCDR3;

CPA.7.012, CPA.7.012.VH, CPA.7.012.VL, CPA.7.012.HC, CPA.7.012.LC, CPA.7.012.H1, CPA.7.012.H2, CPA.7.012.H3 CPA.7.012.H4; CPA.7.012.vhCDR1, CPA.7.012.vhCDR2, CPA.7.012.vhCDR3, CPA.7.012.vlCDR1, CPA.7.012.vlCDR2, and CPA.7.012.vlCDR3;

CPA.7.013, CPA.7.013.VH, CPA.7.013.VL, CPA.7.013.HC, CPA.7.013.LC, CPA.7.013.H1, CPA.7.013.H2, CPA.7.013.H3 CPA.7.013.H4; CPA.7.013.vhCDR1, CPA.7.013.vhCDR2, CPA.7.013.vhCDR3, CPA.7.013.vlCDR1, CPA.7.013.vlCDR2, and CPA.7.013.vlCDR3;

CPA.7.014, CPA.7.014.VH, CPA.7.014.VL, CPA.7.014.HC, CPA.7.014.LC, CPA.7.014.H1, CPA.7.014.H2, CPA.7.014.H3 CPA.7.014.H4; CPA.7.014.vhCDR1, CPA.7.014.vhCDR2, CPA.7.014.vhCDR3, CPA.7.014.vlCDR1, CPA.7.014.vlCDR2, and CPA.7.014.vlCDR3;

CPA.7.015, CPA.7.015.VH, CPA.7.015.VL, CPA.7.015.HC, CPA.7.015.LC, CPA.7.015.H1, CPA.7.015.H2, CPA.7.015.H3 CPA.7.015.H4; CPA.7.015.vhCDR1, CPA.7.015.vhCDR2, CPA.7.015.vhCDR3, CPA.7.015.vlCDR1, CPA.7.015.vlCDR2, and CPA.7.015.vlCDR3;

CPA.7.017, CPA.7.017.VH, CPA.7.017.VL, CPA.7.017.HC, CPA.7.017.LC, CPA.7.017H1, CPA.7.017.H2, CPA.7.017.H3 CPA.7.017.H4; CPA.7.017.vhCDR1, CPA.7.000171.vhCDR2, CPA.7.017.vhCDR3, CPA.7.017.vlCDR1, CPA.7.017.vlCDR2, and CPA.7.017.vlCDR3;

CPA.7.018, CPA.7.018.VH, CPA.7.018.VL, CPA.7.018.HC, CPA.7.018.LC, CPA.7.018.H1, CPA.7.018.H2, CPA.7.018.H3 CPA.7.018.H4; CPA.7.017.vhCDR1, CPA.7.017.vhCDR2, CPA.7.017.vhCDR3, CPA.7.017.vlCDR1, CPA.7.017.vlCDR2, and CPA.7.017.vlCDR3;

CPA.7.019, CPA.7.019.VH, CPA.7.019.VL, CPA.7.019.HC, CPA.7.019.LC, CPA.7.019.H1, CPA.7.019.H2, CPA.7.019.H3 CPA.7.019.H4; CPA.7.019.vhCDR1, CPA.7.019.vhCDR2, CPA.7.019.vhCDR3, CPA.7.019.vlCDR1, CPA.7.019.vlCDR2, and CPA.7.019.vlCDR3;

CPA.7.021, CPA.7.021.VH, CPA.7.021.VL, CPA.7.021.HC, CPA.7.021.LC, CPA.7.021.H1, CPA.7.021.H2, CPA.7.021.H3 CPA.7.021.H4; CPA.7.021.vhCDR1, CPA.7.021.vhCDR2, CPA.7.021.vhCDR3, CPA.7.021.vlCDR1, CPA.7.021.vlCDR2, and CPA.7.021.vlCDR3;

CPA.7.022, CPA.7.022.VH, CPA.7.022.VL, CPA.7.022.HC, CPA.7.022.LC, CPA.7.022.H1, CPA.7.022.H2, CPA.7.022.H3 CPA.7.022.H4; CPA.7.022.vhCDR1, CPA.7.022.vhCDR2,

CPA.7.002201.vhCDR3, CPA.7.022.vlCDR1, CPA.7.022.vlCDR2, and CPA.7.022.vlCDR3;
CPA.7.023, CPA.7.023.VH, CPA.7.023.VL, CPA.7.023.HC, CPA.7.023.LC, CPA.7.023.H1, CPA.7.023.H2, CPA.7.023.H3 CPA.7.023.H4; CPA.7.023.vhCDR1, CPA.7.023.vhCDR2, CPA.7.023.vhCDR3, CPA.7.023.vlCDR1, CPA.7.023.vlCDR2, and CPA.7.023.vlCDR3;
CPA.7.024, CPA.7.024.VH, CPA.7.024.VL, CPA.7.024.HC, CPA.7.024.LC, CPA.7.024.H1, CPA.7.024.H2, CPA.7.024.H3 CPA.7.024.H4; CPA.7.024.vhCDR1, CPA.7.024.vhCDR2, CPA.7.024.vhCDR3, CPA.7.024.vlCDR1, CPA.7.024.vlCDR2, and CPA.7.024.vlCDR3;
CPA.7.033, CPA.7.033.VH, CPA.7.033.VL, CPA.7.033.HC, CPA.7.033.LC, CPA.7.033.H1, CPA.7.033.H2, CPA.7.033.H3 CPA.7.033.H4; CPA.7.033.vhCDR1, CPA.7.033.vhCDR2, CPA.7.033.vhCDR3, CPA.7.033.vlCDR1, CPA.7.033.vlCDR2, and CPA.7.033.vlCDR3;
CPA.7.034, CPA.7.034.VH, CPA.7.034.VL, CPA.7.034.HC, CPA.7.034.LC, CPA.7.034.H1, CPA.7.034.H2, CPA.7.034.H3 CPA.7.034.H4; CPA.7.034.vhCDR1, CPA.7.034.vhCDR2, CPA.7.034.vhCDR3, CPA.7.034.vlCDR1, CPA.7.034.vlCDR2, and CPA.7.034.vlCDR3;
CPA.7.036, CPA.7.036.VH, CPA.7.036.VL, CPA.7.036.HC, CPA.7.036.LC, CPA.7.036.H1, CPA.7.036.H2, CPA.7.036.H3 CPA.7.036.H4; CPA.7.036.vhCDR1, CPA.7.036.vhCDR2, CPA.7.036.vhCDR3, CPA.7.036.vlCDR1, CPA.7.036.vlCDR2, and CPA.7.036.vlCDR3;
CPA.7.040, CPA.7.040.VH, CPA.7.040.VL, CPA.7.040.HC, CPA.7.040.LC, CPA.7.040.H1, CPA.7.040.H2, CPA.7.040.H3 and CPA.7.040.H4; CPA.7.040.vhCDR1, CPA.7.040.vhCDR2, CPA.7.040.vhCDR3, CPA.7.040.vlCDR1, CPA.7.040.vlCDR2, and CPA.7.040.vlCDR3;
CPA.7.046, CPA.7.046.VH, CPA.7.046.VL, CPA.7.046.HC, CPA.7.046.LC, CPA.7.046.H1, CPA.7.046.H2, CPA.7.046.H3 CPA.7.046.H4; CPA.7.046.vhCDR1, CPA.7.046.vhCDR2, CPA.7.046.vhCDR3, CPA.7.046.vlCDR1, CPA.7.046.vlCDR2, and CPA.7.046.vlCDR3;
CPA.7.047, CPA.7.047.VH, CPA.7.047.VL, CPA.7.047.HC, CPA.7.047.LC, CPA.7.047.H1, CPA.7.047.H2, CPA.7.047.H3 CPA.7.047.H4; CPA.7.047.vhCDR1, CPA.7.047.vhCDR2, CPA.7.047.vhCDR3, CPA.7.047.vlCDR1, CPA.7.004701.vlCDR2, and CPA.7.047.vlCDR3;
CPA.7.049, CPA.7.049.VH, CPA.7.049.VL, CPA.7.049.HC, CPA.7.049.LC, CPA.7.049.H1, CPA.7.049.H2, CPA.7.049.H3 CPA.7.049.H4; CPA.7.049.vhCDR1, CPA.7.049.vhCDR2, CPA.7.049.vhCDR3, CPA.7.049.vlCDR1, CPA.7.049.vlCDR2, and CPA.7.049.vlCDR3; and
CPA.7.050, CPA.7.050.VH, CPA.7.050.VL, CPA.7.050.HC, CPA.7.050.LC, CPA.7.050.H1, CPA.7.050.H2, CPA.7.050.H3 CPA.7.050.H4, CPA.7.050.vhCDR1, CPA.7.050.vhCDR2, CPA.7.050.vhCDR3, CPA.7.050.vlCDR1, CPA.7.050.vlCDR2, and CPA.7.050.vlCDR3.

In addition, there are a number of CPA antibodies generated herein that bound to PVRIG but did not block the interaction of PVRIG and PVLR2 as shown in FIGS. 52A-52B, only eight of which sequences are included herein in FIGS. 40A-40D, the components of which are:

CPA.7.028, CPA.7.028.VH, CPA.7.028.VL, CPA.7.028.HC, CPA.7.028.LC, CPA.7.028.H1, CPA.7.028.H2, CPA.7.028.H3 and CPA.7.028.H4; CPA.7.028.vhCDR1, CPA.7.028.vhCDR2, CPA.7.028.vhCDR3, CPA.7.028.vlCDR1, CPA.7.028.vlCDR2, and CPA.7.028.vlCDR3.
CPA.7.030, CPA.7.030.VH, CPA.7.030.VL, CPA.7.030.HC, CPA.7.030.LC, CPA.7.030.H1, CPA.7.030.H2, CPA.7.030.H3 and CPA.7.030.H4; CPA.7.030.vhCDR1, CPA.7.030.vhCDR2, CPA.7.030.vhCDR3, CPA.7.030.vlCDR1, CPA.7.030.vlCDR2, and CPA.7.030.vlCDR3.
CPA.7.041, CPA.7.041.VH, CPA.7.041.VL, CPA.7.041.HC, CPA.7.041.LC, CPA.7.041.H1, CPA.7.041.H2, CPA.7.041.H3 and CPA.7.041.H4; CPA.7.041.vhCDR1, CPA.7.041.vhCDR2, CPA.7.041.vhCDR3, CPA.7.041.vlCDR1, CPA.7.041.vlCDR2, and CPA.7.041.vlCDR3.
CPA.7.016, CPA.7.016.VH, CPA.7.016.VL, CPA.7.016.HC, CPA.7.016.LC, CPA.7.016.H1, CPA.7.016.H2, CPA.7.016.H3 and CPA.7.016.H4; CPA.7.016.vhCDR1, CPA.7.016.vhCDR2, CPA.7.016.vhCDR3, CPA.7.016.vlCDR1, CPA.7.016.vlCDR2, and CPA.7.016.vlCDR3.
CPA.7.020, CPA.7.020.VH, CPA.7.020.VL, CPA.7.020.HC, CPA.7.020.LC, CPA.7.020.H1, CPA.7.020.H2, CPA.7.020.H3 and CPA.7.020.H4; CPA.7.020.vhCDR1, CPA.7.020.vhCDR2, CPA.7.020.vhCDR3, CPA.7.020.vlCDR1, CPA.7.020.vlCDR2, and CPA.7.020.vlCDR3.
CPA.7.038, CPA.7.038.VH, CPA.7.038.VL, CPA.7.038.HC, CPA.7.038.LC, CPA.7.038.H1, CPA.7.038.H2, CPA.7.038.H3 and CPA.7.038.H4; CPA.7.038.vhCDR1, CPA.7.038.vhCDR2, CPA.7.038.vhCDR3, CPA.7.038.vlCDR1, CPA.7.038.vlCDR2, and CPA.7.038.vlCDR3.
CPA.7.044, CPA.7.044.VH, CPA.7.044.VL, CPA.7.044.HC, CPA.7.044.LC, CPA.7.044.H1, CPA.7.044.H2, CPA.7.044.H3 and CPA.7.044.H4; CPA.7.044.vhCDR1, CPA.7.044.vhCDR2, CPA.7.044.vhCDR3, CPA.7.044.vlCDR1, CPA.7.044.vlCDR2, and CPA.7.044.vlCDR3.
CPA.7.045, CPA.7.045.VH, CPA.7.045.VL, CPA.7.045.HC, CPA.7.045.LC, CPA.7.045.H1, CPA.7.045.H2, CPA.7.045.H3 and CPA.7.045.H4; CPA.7.045.vhCDR1, CPA.7.045.vhCDR2, CPA.7.045.vhCDR3, CPA.7.045.vlCDR1, CPA.7.045.vlCDR2, and CPA.7.045.vlCDR3.

As discussed herein, the invention further provides variants of the above components, including variants in the CDRs, as outlined above. In addition, variable heavy chains can be 80%, 90%, 95%, 98% or 99% identical to the "VH" sequences herein, and/or contain from 1, 2, 3, 4, 5, 6, 7, 8, 9, 10 amino acid changes, or more, when Fc variants are used. Variable light chains are provided that can be 80%, 90%, 95%, 98% or 99% identical to the "VL" sequences herein, and/or contain from 1, 2, 3, 4, 5, 6, 7, 8, 9, 10 amino acid changes, or more, when Fc variants are used. Similarly, heavy and light chains are provided that are 80%, 90%, 95%, 98% or 99% identical to the "HC" and "LC" sequences herein, and/or contain from 1, 2, 3, 4, 5, 6, 7, 8, 9, 10 amino acid changes, or more, when Fc variants are used.

Furthermore, the present invention provides a number of CHA antibodies, which are murine antibodies generated from hybridomas. As is well known the art, the six CDRs are useful when put into either human framework variable heavy and variable light regions or when the variable heavy and light domains are humanized.

Accordingly, the present invention provides antibodies, usually full length or scFv domains, that comprise the following CHA sets of CDRs, the sequences of which are shown in FIGS. 41A-41DD:

CHA.7.502.vhCDR1, CHA.7.502.vhCDR2, CHA.7.502.vhCDR3, CHA.7.502.vlCDR1, CHA.7.502.vlCDR2, and CHA.7.502.vlCDR3.
CHA.7.503.vhCDR1, CHA.7.503.vhCDR2, CHA.7.503.vhCDR3, CHA.7.503.vlCDR1, CHA.7.503.vlCDR2, and CHA.7.503.vlCDR3.
CHA.7.506.vhCDR1, CHA.7.506.vhCDR2, CHA.7.506.vhCDR3, CHA.7.506.vlCDR1, CHA.7.506.vlCDR2, and CHA.7.506.vlCDR3.
CHA.7.508.vhCDR1, CHA.7.508.vhCDR2, CHA.7.508.vhCDR3, CHA.7.508.vlCDR1, CHA.7.508.vlCDR2, and CHA.7.508.vlCDR3.
CHA.7.510.vhCDR1, CHA.7.510.vhCDR2, CHA.7.510.vhCDR3, CHA.7.510.vlCDR1, CHA.7.510.vlCDR2, and CHA.7.510.vlCDR3.
CHA.7.512.vhCDR1, CHA.7.512.vhCDR2, CHA.7.512.vhCDR3, CHA.7.512.vlCDR1, CHA.7.512.vlCDR2, and CHA.7.512.vlCDR3.
CHA.7.514.vhCDR1, CHA.7.514.vhCDR2, CHA.7.514.vhCDR3, CHA.7.514.vlCDR1, CHA.7.514.vlCDR2, and CHA.7.514.vlCDR3.
CHA.7.516.vhCDR1, CHA.7.516.vhCDR2, CHA.7.516.vhCDR3, CHA.7.516.vlCDR1, CHA.7.516.vlCDR2, and CHA.7.516.vlCDR3.
CHA.7.518.vhCDR1, CHA.7.518.vhCDR2, CHA.7.518.vhCDR3, CHA.7.518.vlCDR1, CHA.7.518.vlCDR2, and CHA.7.518.vlCDR3.
CHA. 7.520_1.vhCDR1, CHA. 7.520_1.vhCDR2, CHA. 7.520_1.vhCDR3, CHA.7.520_1.vlCDR1, CHA.7.520_1.vlCDR2, and CHA.7.520_1.vlCDR3.
CHA.7.520_2.vhCDR1, CHA.7.520_2.vhCDR2, CHA.7.520_2.vhCDR3, CHA.7.520_2.vlCDR1, CHA.7.520_2.vlCDR2, and CHA.7.520_2.vlCDR3.
CHA.7.522.vhCDR1, CHA.7.522.vhCDR2, CHA.7.522.vhCDR3, CHA.7.522.vlCDR1, CHA.7.522.vlCDR2, and CHA.7.522.vlCDR3.
CHA.7.524.vhCDR1, CHA.7.524.vhCDR2, CHA.7.524.vhCDR3, CHA.7.524.vlCDR1, CHA.7.524.vlCDR2, and CHA.7.524.vlCDR3.
CHA.7.526.vhCDR1, CHA.7.526.vhCDR2, CHA.7.526.vhCDR3, CHA.7.526.vlCDR1, CHA.7.526.vlCDR2, and CHA.7.526.vlCDR3.
CHA.7.527.vhCDR1, CHA.7.527.vhCDR2, CHA.7.527.vhCDR3, CHA.7.527.vlCDR1, CHA.7.527.vlCDR2, and CHA.7.527.vlCDR3.
CHA.7.528.vhCDR1, CHA.7.528.vhCDR2, CHA.7.528.vhCDR3, CHA.7.528.vlCDR1, CHA.7.528.vlCDR2, and CHA.7.528.vlCDR3.
CHA.7.530.vhCDR1, CHA.7.530.vhCDR2, CHA.7.530.vhCDR3, CHA.7.530.vlCDR1, CHA.7.530.vlCDR2, and CHA.7.530.vlCDR3.
CHA.7.534.vhCDR1, CHA.7.534.vhCDR2, CHA.7.534.vhCDR3, CHA.7.534.vlCDR1, CHA.7.534.vlCDR2, and CHA.7.534.vlCDR3.
CHA.7.535.vhCDR1, CHA.7.535.vhCDR2, CHA.7.535.vhCDR3, CHA.7.535.vlCDR1, CHA.7.535.vlCDR2, and CHA.7.535.vlCDR3.
CHA.7.537.vhCDR1, CHA.7.537.vhCDR2, CHA.7.537.vhCDR3, CHA.7.537.vlCDR1, CHA.7.537.vlCDR2, and CHA.7.537.vlCDR3.
CHA.7.538_1.vhCDR1, CHA.7.538_1.vhCDR2, CHA.7.538_1.vhCDR3, CHA.7.538_1.vlCDR1, CHA.7.538_1.vlCDR2, and CHA.7.538_1.vlCDR3.
CHA.7.538_2.vhCDR1, CHA.7.538_2.vhCDR2, CHA.7.538_2.vhCDR3, CHA.7.538_2.vlCDR1, CHA.7.538_2.vlCDR2, and CHA.7.538_2.vlCDR3.
CHA.7.543.vhCDR1, CHA.7.543.vhCDR2, CHA.7.543.vhCDR3, CHA.7.543.vlCDR1, CHA.7.543.vlCDR2, and CHA.7.543.vlCDR3.
CHA.7.544.vhCDR1, CHA.7.544.vhCDR2, CHA.7.544.vhCDR3, CHA.7.544.vlCDR1, CHA.7.544.vlCDR2, and CHA.7.544.vlCDR3.
CHA.7.545.vhCDR1, CHA.7.545.vhCDR2, CHA.7.545.vhCDR3, CHA.7.545.vlCDR1, CHA.7.545.vlCDR2, and CHA.7.545.vlCDR3.
CHA.7.546.vhCDR1, CHA.7.546.vhCDR2, CHA.7.546.vhCDR3, CHA.7.546.vlCDR1, CHA.7.546.vlCDR2, and CHA.7.546.vlCDR3.
CHA.7.547.vhCDR1, CHA.7.547.vhCDR2, CHA.7.547.vhCDR3, CHA.7.547.vlCDR1, CHA.7.547.vlCDR2, and CHA.7.547.vlCDR3.
CHA.7.548.vhCDR1, CHA.7.548.vhCDR2, CHA.7.548.vhCDR3, CHA.7.548.vlCDR1, CHA.7.548.vlCDR2, and CHA.7.548.vlCDR3.
CHA.7.549.vhCDR1, CHA.7.549.vhCDR2, CHA.7.549.vhCDR3, CHA.7.549.vlCDR1, CHA.7.549.vlCDR2, and CHA.7.549.vlCDR3.
CHA.7.550.vhCDR1, CHA.7.550.vhCDR2, CHA.7.550.vhCDR3, CHA.7.550.vlCDR1, CHA.7.550.vlCDR2, and CHA.7.550.vlCDR3.

As above, these sets of CDRs may also be amino acid variants as described above.

In addition, the framework regions of the variable heavy and variable light chains can be humanized as is known in the art (with occasional variants generated in the CDRs as needed), and thus humanized variants of the VH and VL chains of FIGS. 41A-41DD can be generated. Furthermore, the humanized variable heavy and light domains can then be fused with human constant regions, such as the constant regions from IgG1, IgG2, IgG3 and IgG4.

In particular, as is known in the art, murine VH and VL chains can be humanized as is known in the art, for example, using the IgBLAST program of the NCBI website, as outlined in Ye et al. Nucleic Acids Res. 41:W34-W40 (2013), herein incorporated by reference in its entirety for the humanization methods. IgBLAST takes a murine VH and/or VL sequence and compares it to a library of known human germline sequences. As shown herein, for the humanized sequences generated herein, the databases used were IMGT human VH genes (F+ORF, 273 germline sequences) and IMGT human VL kappa genes (F+ORF, 74 germline sequences). An exemplary five CHA sequences were chosen: CHA.7.518, CHA.7.530, CHA.7.538_1, CHA.7.538_2 and CHA.7.524 (see FIGS. 41A-41DD for the VH and VL sequences). For this embodiment of the humanization, human germline IGHV1-46(allele1) was chosen for all 5 as the acceptor sequence and the human heavy chain IGHJ4(allele1) joining region (J gene). For three of four (CHA.7.518, CHA.7.530, CHA.7.538_1 and CHA.7.538_2), human germline IGKV1-39(allele 1) was chosen as the acceptor sequence and human light chain IGKJ2(allele1) (J gene) was chosen. The J gene was chosen from human joining region sequences compiled at IMGT® the international ImMunoGeneTics information system as www.imngt.org. CDRs were defined according to the AbM definition (see www.bioinfo.org.uk/abs/). FIGS. 88A-88I depict humanized sequences as well as some potential changes to optimize binding to PVRIG.

Specific humanized antibodies of CHA antibodies include those shown in FIGS. **88A-88I C. Generation of Additional Antibodies Additional antibodies to human PVRIG can be done as is well known in the art, using well known methods such as those outlined in the examples. Thus, additional anti-PVRIG antibodies can be generated by traditional methods such as immunizing mice (sometimes using DNA immunization, for example, such as is used by Aldevron), followed by screening against human PVRIG protein and hybridoma generation, with antibody purification and recovery.

V. Nucleic Acid Compositions

Nucleic acid compositions encoding the anti-PVRIG antibodies of the invention are also provided, as well as expression vectors containing the nucleic acids and host cells transformed with the nucleic acid and/or expression vector compositions. As will be appreciated by those in the art, the protein sequences depicted herein can be encoded by any number of possible nucleic acid sequences, due to the degeneracy of the genetic code.

The nucleic acid compositions that encode the PVRIG antibodies will depend on the format of the antibody. For traditional, tetrameric antibodies containing two heavy chains and two light chains are encoded by two different nucleic acids, one encoding the heavy chain and one encoding the light chain. These can be put into a single expression vector or two expression vectors, as is known in the art, transformed into host cells, where they are expressed to form the antibodies of the invention. In some embodiments, for example when scFv constructs are used, a single nucleic acid encoding the variable heavy chain-linker-variable light chain is generally used, which can be inserted into an expression vector for transformation into host cells. The nucleic acids can be put into expression vectors that contain the appropriate transcriptional and translational control sequences, including, but not limited to, signal and secretion sequences, regulatory sequences, promoters, origins of replication, selection genes, etc.

Preferred mammalian host cells for expressing the recombinant antibodies according to at least some embodiments of the invention include Chinese Hamster Ovary (CHO cells), PER. C6, HEK293 and others as is known in the art.

The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well known in the art.

To create a scFv gene, the $V_H$- and $V_L$-encoding DNA fragments are operatively linked to another fragment encoding a flexible linker, e.g., encoding the amino acid sequence (Gly4-Ser)3 (SEQ ID NO: 1), such that the $V_H$ and $V_L$ sequences can be expressed as a contiguous single-chain protein, with the $V_L$ and $V_H$ regions joined by the flexible linker (see e.g., Bird et al. (1988) *Science* 242:423-426; Huston et al. (1988) *Proc. Natl. Acad. Sci. USA* 85:5879-5883; McCafferty et al., (1990) *Nature* 348:552-554).

VI. Formulations of Anti-PVRIG Antibodies

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980). Acceptable carriers, excipients, or stabilizers are nontoxic to recipients at the dosages and concentrations employed, and include buffers such as phosphate, citrate, acetate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl orbenzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; sweeteners and other flavoring agents; fillers such as microcrystalline cellulose, lactose, corn and other starches; binding agents; additives; coloring agents; salt-forming counter-ions such as sodium; metal complexes (e.g. Zn-protein complexes); and/or non-ionic surfactants such as TWEEN™, PLURONICS™ or polyethylene glycol (PEG).

In a preferred embodiment, the pharmaceutical composition that comprises the antibodies of the invention may be in a water-soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids such as hydrochloric acid, hydrobromic acid, sulfuric acid, nitric acid, phosphoric acid and the like, and organic acids such as acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p-toluenesulfonic acid, salicylic acid and the like. "Pharmaceutically acceptable base addition salts" include those derived from inorganic bases such as sodium, potassium, lithium, ammonium, calcium, magnesium, iron, zinc, copper, manganese, aluminum salts and the like. Particularly preferred are the ammonium, potassium, sodium, calcium, and magnesium salts. Salts derived from pharmaceutically acceptable organic non-toxic bases include salts of primary, secondary, and tertiary amines, substituted amines including naturally occurring substituted amines, cyclic amines and basic ion exchange resins, such as isopropylamine, trimethylamine, diethylamine, triethylamine, tripropylamine, and ethanolamine. The formulations to be used for in vivo administration are preferrably sterile. This is readily accomplished by filtration through sterile filtration membranes or other methods.

Administration of the pharmaceutical composition comprising antibodies of the present invention, preferably in the form of a sterile aqueous solution, may be done in a variety of ways, including, but not limited to subcutaneously and intravenously. Subcutaneous administration may be preferable in some circumstances because the patient may self-administer the pharmaceutical composition. Many protein therapeutics are not sufficiently potent to allow for formulation of a therapeutically effective dose in the maximum acceptable volume for subcutaneous administration. This problem may be addressed in part by the use of protein formulations comprising arginine-HCl, histidine, and polysorbate (see WO 04091658). Fc polypeptides of the present invention may be more amenable to subcutaneous administration due to, for example, increased potency, improved serum half-life, or enhanced solubility.

As is known in the art, protein therapeutics are often delivered by IV infusion or bolus. The antibodies of the present invention may also be delivered using such methods. For example, administration may venious be by intravenous infusion with 0.9% sodium chloride as an infusion vehicle.

In addition, any of a number of delivery systems are known in the art and may be used to administer the Fc variants of the present invention. Examples include, but are not limited to, encapsulation in liposomes, microparticles, microspheres (eg. PLA/PGA microspheres), and the like. Alternatively, an implant of a porous, non-porous, or gelatinous material, including membranes or fibers, may be used. Sustained release systems may comprise a polymeric material or matrix such as polyesters, hydrogels, poly(vinylalcohol), polylactides, copolymers of L-glutamic acid and ethyl-L-gutamate, ethylene-vinyl acetate, lactic acid-glycolic acid copolymers such as the LUPRON DEPOT®, and poly-D-(−)-3-hydroxyburyric acid. The antibodies disclosed herein may also be formulated as immunoliposomes. A liposome is a small vesicle comprising various types of lipids, phospholipids and/or surfactant that is useful for delivery of a therapeutic agent to a mammal. Liposomes containing the antibody are prepared by methods known in the art, such as described in Epstein et al., 1985, Proc Natl Acad Sci USA, 82:3688; Hwang et al., 1980, Proc Natl Acad Sci USA, 77:4030; U.S. Pat. No. 4,485,045; U.S. Pat. No. 4,544,545; and PCT WO 97/38731. Liposomes with enhanced circulation time are disclosed in U.S. Pat. No. 5,013,556. The components of the liposome are commonly arranged in a bilayer formation, similar to the lipid arrangement of biological membranes. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. A chemotherapeutic agent or other therapeutically active agent is optionally contained within the liposome (Gabizon et al., 1989, J National Cancer Inst 81:1484).

The antibodies may also be entrapped in microcapsules prepared by methods including but not limited to coacervation techniques, interfacial polymerization (for example using hydroxymethylcellulose or gelatin-microcapsules, or poly-(methylmethacylate) microcapsules), colloidal drug delivery systems (for example, liposomes, albumin microspheres, microemulsions, nano-particles and nanocapsules), and macroemulsions. Such techniques are disclosed in Remington's Pharmaceutical Sciences 16th edition, Osol, A. Ed., 1980. Sustained-release preparations may be prepared. Suitable examples of sustained-release preparations include semipermeable matrices of solid hydrophobic polymer, which matrices are in the form of shaped articles, e.g. films, or microcapsules. Examples of sustained-release matrices include polyesters, hydrogels (for example poly(2-hydroxyethyl-methacrylate), or poly(vinylalcohol)), polylactides (U.S. Pat. No. 3,773,919), copolymers of L-glutamic acid and gamma ethyl-L-glutamate, non-degradable ethylene-vinyl acetate, degradable lactic acid-glycolic acid copolymers such as the LUPRON DEPOT™ (which are injectable microspheres composed of lactic acid-glycolic acid copolymer and leuprolide acetate), poly-D-(−)-3-hydroxybutyric acid, and ProLease® (commercially available from Alkermes), which is a microsphere-based delivery system composed of the desired bioactive molecule incorporated into a matrix of poly-DL-lactide-co-glycolide (PLG).

The dosing amounts and frequencies of administration are, in a preferred embodiment, selected to be therapeutically or prophylactically effective. As is known in the art, adjustments for protein degradation, systemic versus localized delivery, and rate of new protease synthesis, as well as the age, body weight, general health, sex, diet, time of administration, drug interaction and the severity of the condition may be necessary, and will be ascertainable with routine experimentation by those skilled in the art.

The concentration of the antibody in the formulation may vary from about 0.1 to 100 weight %. In a preferred embodiment, the concentration of the Fc variant is in the range of 0.003 to 1.0 molar. In order to treat a patient, a therapeutically effective dose of the Fc variant of the present invention may be administered. By "therapeutically effective dose" herein is meant a dose that produces the effects for which it is administered. The exact dose will depend on the purpose of the treatment, and will be ascertainable by one skilled in the art using known techniques. Dosages may range from 0.0001 to 100 mg/kg of body weight or greater, for example 0.1, 1, 10, or 50 mg/kg of body weight, with 1 to 10 mg/kg being preferred.

VII. Methods of Using Anti-PVRIG Antibodies

Once made, the anti-PVRIG antibodies of the invention find use in a number of different applications.

A. Therapeutic Uses

The anti-PVRIG antibodies of the invention find use in treating patients, such as human subjects, generally with a condition associated with PVRIG. The term "treatment" as used herein, refers to both therapeutic treatment and prophylactic or preventative measures, which in this example relates to treatment of cancer; however, also as described below, uses of antibodies and pharmaceutical compositions are also provided for treatment of infectious disease, sepsis, and/or autoimmune conditions, and/or for inhibiting an undesirable immune activation that follows gene therapy. Those in need of treatment include those already with cancer as well as those in which the cancer is to be prevented. Hence, the mammal to be treated herein may have been diagnosed as having the cancer or may be predisposed or susceptible to the cancer. As used herein the term "treating" refers to preventing, delaying the onset of, curing, reversing, attenuating, alleviating, minimizing, suppressing, halting the deleterious effects or stabilizing of discernible symptoms of the above-described cancerous diseases, disorders or conditions. It also includes managing the cancer as described above. By "manage" it is meant reducing the severity of the disease, reducing the frequency of episodes of the disease, reducing the duration of such episodes, reducing the severity of such episodes, slowing/reducing cancer cell growth or proliferation, slowing progression of at least one symptom, amelioration of at least one measurable physical parameter and the like. For example, immunostimulatory anti-PVRIG immune molecules should promote T cell or NK or cytokine immunity against target cells, e.g., cancer, infected or pathogen cells and thereby treat cancer or infectious diseases by depleting the cells involved in the disease condition. Conversely, immunoinhibitory anti-PVRIG immune molecules should reduce T cell or NK activity and/or or the secretion of proinflammatory cytokines which are involved in the disease pathology of some immune disease such as autoimmune, inflammatory or allergic conditions and thereby treat or ameliorate the disease pathology and tissue destruction that may be associated with such conditions (e.g., joint destruction associated with rheumatoid arthritis conditions).

The PVRIG antibodies of the invention are provided in therapeutically effective dosages. A "therapeutically effective dosage" of an anti-PVRIG immune molecule according to at least some embodiments of the present invention preferably results in a decrease in severity of disease symptoms, an increase in frequency and duration of disease symptom-free periods, an increase in lifespan, disease remission, or a prevention or reduction of impairment or disability due to the disease affliction. For example, for the treatment of PVRIG positive tumors, a "therapeutically effective dosage" preferably inhibits cell growth or tumor growth by at least about 20%, more preferably by at least about 40%, even more preferably by at least about 60%, and still more preferably by at least about 80% relative to untreated subjects. The ability of a compound to inhibit tumor growth can be evaluated in an animal model system predictive of efficacy in human tumors. Alternatively, this property of a composition can be evaluated by examining the ability of the compound to inhibit, such inhibition in vitro by assays known to the skilled practitioner. A therapeutically effective amount of a therapeutic compound can decrease tumor size, or otherwise ameliorate symptoms in a subject.

One of ordinary skill in the art would be able to determine a therapeutically effective amount based on such factors as the subject's size, the severity of the subject's symptoms, and the particular composition or route of administration selected.

1. Cancer Treatment

The PVRIG antibodies of the invention find particular use in the treatment of cancer. In general, the antibodies of the invention are immunomodulatory, in that rather than directly attack cancerous cells, the anti-PVRIG antibodies of the invention stimulate the immune system, generally by inhibiting the action of PVRIG. Thus, unlike tumor-targeted therapies, which are aimed at inhibiting molecular pathways that are crucial for tumor growth and development, and/or depleting tumor cells, cancer immunotherapy is aimed to stimulate the patient's own immune system to eliminate cancer cells, providing long-lived tumor destruction. Various approaches can be used in cancer immunotherapy, among them are therapeutic cancer vaccines to induce tumor-specific T cell responses, and immunostimulatory antibodies (i.e. antagonists of inhibitory receptors=immune checkpoints) to remove immunosuppressive pathways.

Clinical responses with targeted therapy or conventional anti-cancer therapies tend to be transient as cancer cells develop resistance, and tumor recurrence takes place. However, the clinical use of cancer immunotherapy in the past few years has shown that this type of therapy can have durable clinical responses, showing dramatic impact on long term survival. However, although responses are long term, only a small number of patients respond (as opposed to conventional or targeted therapy, where a large number of patients respond, but responses are transient).

By the time a tumor is detected clinically, it has already evaded the immune-defense system by acquiring immunoresistant and immunosuppressive properties and creating an immunosuppressive tumor microenvironment through various mechanisms and a variety of immune cells.

Accordingly, the anti-PVRIG antibodies of the invention are useful in treating cancer. Due to the nature of an immuno-oncology mechanism of action, PVRIG does not necessarily need to be overexpressed on or correlated with a particular cancer type; that is, the goal is to have the anti-PVRIG antibodies de-suppress T cell and NK cell activation, such that the immune system will go after the cancers.

"Cancer," as used herein, refers broadly to any neoplastic disease (whether invasive or metastatic) characterized by abnormal and uncontrolled cell division causing malignant growth or tumor (e.g., unregulated cell growth.) The term "cancer" or "cancerous" as used herein should be understood to encompass any neoplastic disease (whether invasive, non-invasive or metastatic) which is characterized by abnormal and uncontrolled cell division causing malignant growth or tumor, non-limiting examples of which are described herein. This includes any physiological condition in mammals that is typically characterized by unregulated cell growth. Examples of cancer are exemplified in the working examples and also are described within the specification.

Non-limiting examples of cancer that can be treated using anti-PVRIG antibodies include, but are not limited to, carcinoma, lymphoma, blastoma, sarcoma, and leukemia. More particular examples of such cancers include squamous cell cancer, lung cancer (including small-cell lung cancer, non-small cell lung cancer, adenocarcinoma of the lung, and squamous carcinoma of the lung), cancer of the peritoneum, hepatocellular cancer, gastric or stomach cancer (including gastrointestinal cancer), pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney or renal cancer, liver cancer, prostate cancer, vulval cancer, thyroid cancer, hepatic carcinoma and various types of head and neck cancer, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenström's Macroglobulinemia); chronic lymphocytic leukemia (CLL); acute lymphoblastic leukemia (ALL); Hairy cell leukemia; chronic myeloblastic leukemia; multiple myeloma and post-transplant lymphoproliferative disorder (PTLD).

Other cancers amenable for treatment by the present invention include, but are not limited to, carcinoma, lymphoma, blastoma, sarcoma, and leukemia or lymphoid malignancies. More particular examples of such cancers include colorectal, bladder, ovarian, melanoma, squamous cell cancer, lung cancer (including small-cell lung cancer, non-small cell lung cancer, adenocarcinoma of the lung, and squamous carcinoma of the lung), cancer of the peritoneum, hepatocellular cancer, gastric or stomach cancer (including gastrointestinal cancer), pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney or renal cancer, liver cancer, prostate cancer, vulval cancer, thyroid cancer, hepatic carcinoma and various types of head and neck cancer, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenström's Macroglobulinemia); chronic lymphocytic leukemia (CLL); acute lymphoblastic leukemia (ALL);

Hairy cell leukemia; chronic myeloblastic leukemia; and post-transplant lymphoproliferative disorder (PTLD), as well as abnormal vascular proliferation associated with phakomatoses, edema (such as that associated with brain tumors), and Meigs' syndrome. Preferably, the cancer is selected from the group consisting of colorectal cancer, breast cancer, rectal cancer, non-small cell lung cancer, non-Hodgkin's lymphoma (NHL), renal cell cancer, prostate cancer, liver cancer, pancreatic cancer, soft-tissue sarcoma, Kaposi's sarcoma, carcinoid carcinoma, head and neck cancer, melanoma, ovarian cancer, mesothelioma, and multiple myeloma. In an exemplary embodiment the cancer is an early or advanced (including metastatic) bladder, ovarian or melanoma. In another embodiment the cancer is colorectal cancer. The cancerous conditions amenable for treatment of the invention include cancers that express or do not express PVRIG and further include non-metastatic or non-invasive as well as invasive or metastatic cancers wherein PVRIG expression by immune, stromal or diseased cells suppress antitumor responses and anti-invasive immune responses. The method of the present invention is particularly suitable for the treatment of vascularized tumors.

As shown in the Examples, PVRIG is over expressed and/or correlates with tumor lymphocyte infiltration (as demonstrated by correlation to CD3, CD4, CD8 and PD-1 expression) in a number of different tumors of various origins, and thus is useful in treating any cancer, including but not limited to, prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (non-Hodgkins' lymphoma (NHL) and Hodgkin's lymphoma (HD)), Acute myeloid leukemia (AML),), T cell Acute Lymphoblastic Leukemia (T-ALL), Diffuse Large B cell lymphoma, testicular germ cell tumors, mesothelioma and esophageal cancer.

"Cancer therapy" herein refers to any method which prevents or treats cancer or ameliorates one or more of the symptoms of cancer. Typically such therapies will comprises administration of immunostimulatory anti-PVRIG antibodies (including antigen-binding fragments) either alone or in combination with chemotherapy or radiotherapy or other biologics and for enhancing the activity thereof, i.e., in individuals wherein expression of PVRIG suppresses antitumor responses and the efficacy of chemotherapy or radiotherapy or biologic efficacy.

2. Combination Therapies in Cancer

As is known in the art, combination therapies comprising a therapeutic antibody targeting an immunotherapy target and an additional therapeutic agent, specific for the disease condition, are showing great promise. For example, in the area of immunotherapy, there are a number of promising combination therapies using a chemotherapeutic agent (either a small molecule drug or an anti-tumor antibody) with immuno-oncology antibodies like anti-PD-1, and as such, the anti-PVRIG antibodies outlined herein can be substituted in the same way. Any chemotherapeutic agent exhibiting anticancer activity can be used according to the present invention; various non-limiting examples are described in the specification.

The underlying scientific rationale for the dramatic increased efficacy of combination therapy claims that immune checkpoint blockade as a monotherapy will induce tumor regressions only when there is pre-existing strong anti-tumor immune response to be 'unleashed' when the pathway is blocked. However, in most patients and tumor types the endogenous anti-tumor immune responses are weak, and thus the induction of anti-tumor immunity is required for the immune checkpoint blockade to be effective, as shown in the FIG. 1 According to at least some embodiments of the present invention, PVRIG-specific antibodies, antibody fragments, conjugates and compositions comprising same, are used for treatment of all types of cancer in cancer immunotherapy in combination therapy.

The terms "in combination with" and "co-administration" are not limited to the administration of said prophylactic or therapeutic agents at exactly the same time. Instead, it is meant that the anti-PVRIG antibody and the other agent or agents are administered in a sequence and within a time interval such that they may act together to provide a benefit that is increased versus treatment with only either anti-PVRIG antibody of the present invention or the other agent or agents. It is preferred that the anti-PVRIG antibody and the other agent or agents act additively, and especially preferred that they act synergistically. Such molecules are suitably present in combination in amounts that are effective for the purpose intended. The skilled medical practitioner can determine empirically, or by considering the pharmacokinetics and modes of action of the agents, the appropriate dose or doses of each therapeutic agent, as well as the appropriate timings and methods of administration.

Accordingly, the antibodies of the present invention may be administered concomitantly with one or more other therapeutic regimens or agents. The additional therapeutic regimes or agents may be used to improve the efficacy or safety of the anti-PVRIG antibody. Also, the additional therapeutic regimes or agents may be used to treat the same disease or a comorbidity rather than to alter the action of the PVRIG antibody. For example, a PVRIG antibody of the present invention may be administered to the patient along with chemotherapy, radiation therapy, or both chemotherapy and radiation therapy.

The PVRIG antibodies of the present invention may be administered in combination with one or more other prophylactic or therapeutic agents, including but not limited to cytotoxic agents, chemotherapeutic agents, cytokines, growth inhibitory agents, anti-hormonal agents, kinase inhibitors, anti-angiogenic agents, cardioprotectants, immunostimulatory agents, immunosuppressive agents, agents that promote proliferation of hematological cells, angiogenesis inhibitors, protein tyrosine kinase (PTK) inhibitors, or other therapeutic agents.

According to at least some embodiments, the anti PVRIG immune molecules could be used in combination with any of the known in the art standard of care cancer treatment (as can be found, for example, in http://www.cancer.gov/cancertopics).

For example, the combination therapy can include an anti PVRIG antibody combined with at least one other therapeutic or immune modulatory agent, other compounds or immunotherapies, or immunostimulatory strategy as described herein. including, but not limited to, tumor vaccines, adoptive T cell therapy, Treg depletion, antibodies (e.g. bevacizumab, Erbitux), peptides, pepti-bodies, small molecules, chemotherapeutic agents such as cytotoxic and cytostatic agents (e.g. paclitaxel, cisplatin, vinorelbine, docetaxel, gemcitabine, temozolomide, irinotecan, 5FU, carboplatin), immunological modifiers such as interferons and interleukins, immunostimulatory antibodies, growth hormones or other cytokines, folic acid, vitamins, minerals, aromatase inhibitors, RNAi, Histone Deacetylase Inhibitors, proteasome inhibitors, doxorubicin (Adriamycin), cisplatin bleomycin sulfate, carmustine, chlorambucil, and cyclophosphamide hydroxyurea which, by themselves, are only effective at levels which are toxic or subtoxic to a patient. Cisplatin is intravenously administered as a 100 mg/dose once every four weeks and Adriamycin is intravenously administered as a 60-75 mg/ml dose once every 21 days.

According to at least some embodiments of the present invention, therapeutic agents that can be used in combination with anti-PVRIG antibodies are other potentiating agents that enhance anti-tumor responses, e.g. other anti-immune checkpoint antibodies or other potentiating agents that are primarily geared to increase endogenous anti-tumor responses, such as Radiotherapy, Cryotherapy, Conventional/classical chemotherapy potentiating anti-tumor immune responses, Targeted therapy potentiating anti-tumor immune responses, Anti-angiogenic therapy, Therapeutic agents targeting immunosuppressive cells such as Tregs and MDSCs, Immunostimulatory antibodies, Cytokine therapy, Therapeutic cancer vaccines, Adoptive cell transfer.

In some embodiments, anti-PVRIG antibodies are used in combination with Bisphosphonates, especially amino-bisphosphonates (ABP), which have shown to have anti-cancer activity. Some of the activities associated with ABPs are on human γδT cells that straddle the interface of innate and adaptive immunity and have potent anti-tumour activity.

Targeted therapies can also stimulate tumor-specific immune response by inducing the immunogenic death of tumor cells or by engaging immune effector mechanisms (Galluzzi et al, 2012, *Nature Reviews—Drug discovery*, Volume 11, pages 215-233).

According to at least some embodiments of the invention, targeted therapies used as agents for combination with anti PVRIG immune molecules for treatment of cancer are as described herein.

In some embodiments, anti-PVRIG antibodies are used in combination with therapeutic agents targeting regulatory immunosuppressive cells such as regulatory T cells (Tregs) and myeloid derived suppressor cells (MDSCs). A number of commonly used chemotherapeutics exert non-specific targeting of Tregs and reduce the number or the immunosuppressive capacity of Tregs or MDSCs (Facciabene A. et al 2012 *Cancer Res;* 72(9) 2162-71; Byrne W L. et al 2011, *Cancer Res.* 71:691520; Gabrilovich D I. and Nagaraj S, *Nature Reviews* 2009 Volume 9, pages 162-174). In this regard, metronomic therapy with some chemotherapy drugs results in immunostimulatory rather than immunosuppressive effects, via modulation of regulatory cells. Thus, according to at least some embodiments of the present invention, anti-PVRIG immune molecule for cancer immunotherapy is used in combination with drugs selected from but not limited to cyclophosphamide, gemcitabine, mitoxantrone, fludarabine, fludarabine, docetaxel, paclitaxel, thalidomide and thalidomide derivatives.

In some embodiments, anti-PVRIG antibodies are used in combination with novel Treg-specific targeting agents including: 1) depleting or killing antibodies that directly target Tregs through recognition of Treg cell surface receptors such as anti-CD25 mAbs daclizumab, basiliximab or 2) ligand-directed toxins such as denileukin diftitox (Ontak)—a fusion protein of human IL-2 and diphtheria toxin, or LMB-2—a fusion between an scFv against CD25 and Pseudomonas exotoxin and 3) antibodies targeting Treg cell surface receptors such as CTLA4, PD-1, OX40 and GITR or 4) antibodies, small molecules or fusion proteins targeting other NK receptors such as previously identified.

In some embodiments, anti-PVRIG antibodies are used in combination with any of the options described below for disrupting Treg induction and/or function, including TLR (toll like receptors) agonists; agents that interfere with the adenosinergic pathway, such as ectonucleotidase inhibitors, or inhibitors of the A2A adenosine receptor; TGF-β inhibitors, such as fresolimumab, lerdelimumab, metelimumab, trabedersen, LY2157299, LY210976; blockade of Tregs recruitment to tumor tissues including chemokine receptor inhibitors, such as the CCR4/CCL2/CCL22 pathway.

In some embodiments, anti-PVRIG antibodies are used in combination with any of the options described below for inhibiting the immunosuppressive tumor microenvironment, including inhibitors of cytokines and enzymes which exert immunosuppressive activities, such as IDO (indoleamine-2, 3-dioxygenase) inhibitors; inhibitors of anti-inflammatory cytokines which promote an immunosuppressive microenvironment, such as IL-10, IL-35, IL-4 and IL-13; Bevacizumab® which reduces Tregs and favors the differentiation of DCs.

In some embodiments, anti-PVRIG antibodies are used in combination with any of the options described below for targeting MDSCs (myeloid-derived suppressive cells), including promoting their differentiation into mature myeloid cells that do not have suppressive functions by Vitamin D3, or Vitamin A metabolites, such as retinoic acid, all-trans retinoic acid (ATRA); inhibition of MDSCs suppressive activity by COX2 inhibitors, phosphodiesterase 5 inhibitors like sildenafil, ROS inhibitors such as nitroaspirin.

In some embodiments, anti-PVRIG antibodies are used in combination with immunostimulatory antibodies or other agents which potentiate anti-tumor immune responses (Pardoll *J Exp Med.* 2012; 209(2): 201-209). Immunostimulatory antibodies promote anti-tumor immunity by directly modulating immune functions, i.e. blocking other inhibitory targets or enhancing immunostimulatory proteins. According to at least some embodiments of the present invention, anti-PVRIG immune molecules for cancer immunotherapy is used in combination with antagonistic antibodies targeting additional immune checkpoints including anti-CTLA4 mAbs, such as ipilimumab, tremelimumab; anti-PD-1 such as nivolumab BMS-936558/MDX-1106/ONO-4538, AMP224, CT-011, MK-3475, anti-PDL-1 antagonists such as BMS-936559/MDX-1105, MEDI4736, RG-7446/MPDL3280A; Anti-LAG-3 such as IMP-321), anti-TIM-3, anti-BTLA, anti-B7-H4, anti-B7-H3, Anti-VISTA; Agonistic antibodies targeting immunostimulatory proteins, including anti-CD40 mAbs such as CP-870,893, lucatumumab, dacetuzumab; anti-CD137 mAbs such as BMS-663513 urelumab, PF-05082566; anti-OX40 mAbs, such as anti-OX40; anti-GITR mAbs such as TRX518; anti-CD27 mAbs, such as CDX-1127; and anti-ICOS mAbs.

n some embodiments, anti-PVRIG antibodies are used in combination with cytokines. A number of cytokines are in preclinical or clinical development as agents potentiating anti-tumor immune responses for cancer immunotherapy, including among others: IL-2, IL-7, IL-12, IL-15, IL-17, IL-18 and IL-21, IL-23, IL-27, GM-CSF, IFNα (interferon α), IFNβ, and IFNγ. However, therapeutic efficacy is often hampered by severe side effects and poor pharmacokinetic properties. Thus, in addition to systemic administration of cytokines, a variety of strategies can be employed for the delivery of therapeutic cytokines and their localization to the tumor site, in order to improve their pharmacokinetics, as well as their efficacy and/or toxicity, including antibody-cytokine fusion molecules (immunocytokines), chemical conjugation to polyethylene glycol (PEGylation), transgenic expression of cytokines in autologous whole tumor cells, incorporation of cytokine genes into DNA vaccines, recombinant viral vectors to deliver cytokine genes, etc. In the case of immunocytokines, fusion of cytokines to tumor-specific antibodies or antibody fragments allows for targeted delivery and therefore improved efficacy and pharmacokinetics, and reduced side effects.

In some embodiments, anti-PVRIG antibodies are used in combination with cancer vaccines. Therapeutic cancer vaccines allow for improved priming of T cells and improved antigen presentation, and can be used as therapeutic agents for potentiating anti-tumor immune responses (Mellman I. et al., 2011, *Nature*, 480:22-29; Schlom J, 2012, *J Natl Cancer Inst;* 104:599-613).

Several types of therapeutic cancer vaccines are in preclinical and clinical development. These include for example:

1) Whole tumor cell vaccines, in which cancer cells removed during surgery are treated to enhance their immunogenicity, and injected into the patient to induce immune responses against antigens in the tumor cells. The tumor cell vaccine can be autologous, i.e. a patient's own tumor, or allogeneic which typically contain two or three established and characterized human tumor cell lines of a given tumor type, such as the GVAX vaccine platforms.

2) Tumor antigen vaccines, in which a tumor antigen (or a combination of a few tumor antigens), usually proteins or peptides, are administered to boost the immune system (possibly with an adjuvant and/or with immune modulators or attractants of dendritic cells such as GM-CSF). The tumor antigens may be specific for a certain type of cancer, but they are not made for a specific patient.

3) Vector-based tumor antigen vaccines and DNA vaccines can be used as a way to provide a steady supply of antigens to stimulate an anti-tumor immune response. Vectors encoding for tumor antigens are injected into the patient (possibly with proinflammatory or other attractants such as GM-CSF), taken up by cells in vivo to make the specific antigens, which would then provoke the desired immune response. Vectors may be used to deliver more than one tumor antigen at a time, to increase the immune response. In addition, recombinant virus, bacteria or yeast vectors should trigger their own immune responses, which may also enhance the overall immune response.

4) Oncolytic virus vaccines, such as OncoVex/T-VEC, which involves the intratumoral injection of replication-conditional herpes simplex virus which preferentially infects cancer cells. The virus, which is also engineered to express GM-CSF, is able to replicate inside a cancer cell causing its lysis, releasing new viruses and an array of tumor antigens, and secreting GM-CSF in the process. Thus, such oncolytic virus vaccines enhance DCs function in the tumor microenvironment to stimulate anti-tumor immune responses.

5) Dendritic cell vaccines (Palucka and Banchereau, 2102, *Nat. Rev. Cancer,* 12(4):265-277): Dendritic cells (DCs) phagocytose tumor cells and present tumor antigens to tumor specific T cells. In this approach, DCs are isolated from the cancer patient and primed for presenting tumor-specific T cells. To this end several methods can be used: DCs are loaded with tumor cells or lysates; DCs are loaded with fusion proteins or peptides of tumor antigens; coupling of tumor antigens to DC-targeting mAbs. The DCs are treated in the presence of a stimulating factor (such as GM-CSF), activated and matured ex vivo, and then re-infused back into the patient in order provoke an immune response to the cancer cells. Dendritic cells can also be primed in vivo by injection of patients with irradiated whole tumor cells engineered to secrete stimulating cytokines (such as GM-CSF). Similar approaches can be carried out with monocytes. Sipuleucel-T (Provenge), a therapeutic cancer vaccine which has been approved for treatment of advanced prostate cancer, is an example of a dendritic cell vaccine.

In some embodiments, anti-PVRIG antibodies are used in combination with adoptive T cell therapy or adoptive cell transfer (ACT), which involves the ex vivo identification and expansion of autologous naturally occurring tumor specific T cells, which are then adoptively transferred back into the cancer patient (Restifo et al, 2013, *Cancer Immunol. Immunother.* 62(4): 727-36 (2013) Epub Dec. 4, 2012). Cells that are infused back into a patient after ex vivo expansion can traffic to the tumor and mediate its destruction. Prior to this adoptive transfer, hosts can be immunodepleted by irradiation and/or chemotherapy. The combination of lymphodepletion, adoptive cell transfer, and a T cell growth factor (such as IL-2), can lead to prolonged tumor eradication in tumor patients. A more novel approach involves the ex vivo genetic modification of normal peripheral blood T cells to confer specificity for tumor-associated antigens. For example, clones of TCRs of T cells with particularly good anti-tumor responses can be inserted into viral expression vectors and used to infect autologous T cells from the patient to be treated. Another option is the use of chimeric antigen receptors (CARs) which are essentially a chimeric immunoglobulin-TCR molecule, also known as a T-body. CARs have antibody-like specificities and recognize MHC-nonrestricted structures on the surface of target cells (the extracellular target-binding module), grafted onto the TCR intracellular domains capable of activating T cells (Restifo et al *Cancer Immunol. Immunother.* 62(4):727-36 (2013) Epub Dec. 4, 2012; and Shi et al, *Nature* 493:111-115 2013.

The PVRIG antibodies and the one or more other therapeutic agents can be administered in either order or simultaneously. The composition can be linked to the agent (as an immunocomplex) or can be administered separately from the agent. In the latter case (separate administration), the composition can be administered before, after or concurrently with the agent or can be co-administered with other known therapies, e.g., an anti-cancer therapy, e.g., radiation.

Co-administration of the humanized anti-PVRIG immune molecules, according to at least some embodiments of the present invention with chemotherapeutic agents provides two anti-cancer agents which operate via different mechanisms which yield a cytotoxic effect to human tumor cells. Such co-administration can solve problems due to development of resistance to drugs or a change in the antigenicity of the tumor cells which would render them unreactive with the antibody. In other embodiments, the subject can be additionally treated with an agent that modulates, e.g., enhances or inhibits, the expression or activity of Fcγ or Fcγ receptors by, for example, treating the subject with a cytokine.

Target-specific effector cells, e.g., effector cells linked to compositions (e.g., human antibodies, multispecific and bispecific molecules) according to at least some embodiments of the present invention can also be used as therapeutic agents. Effector cells for targeting can be human leukocytes such as macrophages, neutrophils or monocytes. Other cells include eosinophils, natural killer cells and other IgG- or IgA-receptor bearing cells. If desired, effector cells can be obtained from the subject to be treated. The target-specific effector cells can be administered as a suspension of cells in a physiologically acceptable solution. The number of cells administered can be in the order of $10^{-8}$ to $10^{-9}$ but will vary depending on the therapeutic purpose. In general, the amount will be sufficient to obtain localization at the target cell, e.g., a tumor cell expressing PVRIG proteins, and to effect cell killing e.g., by, e.g., phagocytosis. Routes of administration can also vary.

Therapy with target-specific effector cells can be performed in conjunction with other techniques for removal of targeted cells. For example, anti-tumor therapy using the compositions (e.g., human antibodies, multispecific and bispecific molecules) according to at least some embodiments of the present invention and/or effector cells armed with these compositions can be used in conjunction with chemotherapy. Additionally, combination immunotherapy may be used to direct two distinct cytotoxic effector populations toward tumor cell rejection. For example, anti-PVRIG immune molecules linked to anti-Fc-ɣRI or anti-CD3 may be used in conjunction with IgG- or IgA-receptor specific binding agents.

Bispecific and multispecific molecules according to at least some embodiments of the present invention can also be used to modulate FcɣR or FcɣR levels on effector cells, such as by capping and elimination of receptors on the cell surface. Mixtures of anti-Fc receptors can also be used for this purpose.

The therapeutic compositions (e.g., human antibodies, alternative scaffolds multispecific and bispecific molecules and immunoconjugates) according to at least some embodiments of the present invention which have complement binding sites, such as portions from IgG1, -2, or -3 or IgM which bind complement, can also be used in the presence of complement. In one embodiment, ex vivo treatment of a population of cells comprising target cells with a binding agent according to at least some embodiments of the present invention and appropriate effector cells can be supplemented by the addition of complement or serum containing complement. Phagocytosis of target cells coated with a binding agent according to at least some embodiments of the present invention can be improved by binding of complement proteins. In another embodiment target cells coated with the compositions (e.g., human antibodies, multispecific and bispecific molecules) according to at least some embodiments of the present invention can also be lysed by complement. In yet another embodiment, the compositions according to at least some embodiments of the present invention do not activate complement.

The therapeutic compositions (e.g., human antibodies, alternative scaffolds multispecific and bispecific molecules and immunoconjugates) according to at least some embodiments of the present invention can also be administered together with complement. Thus, according to at least some embodiments of the present invention there are compositions, comprising human antibodies, multispecific or bispecific molecules and serum or complement. These compositions are advantageous in that the complement is located in close proximity to the human antibodies, multispecific or bispecific molecules. Alternatively, the human antibodies, multispecific or bispecific molecules according to at least some embodiments of the present invention and the complement or serum can be administered separately.

The anti-PVRIG immune molecules, according to at least some embodiments of the present invention, can be used as neutralizing antibodies. A neutralizing antibody (Nabs), is an antibody that is capable of binding and neutralizing or inhibiting a specific antigen thereby inhibiting its biological effect. NAbs will partially or completely abrogate the biological action of an agent by either blocking an important surface molecule needed for its activity or by interfering with the binding of the agent to its receptor on a target cell.

According to an additional aspect of the present invention the therapeutic agents can be used to prevent pathologic inhibition of T cell activity, such as that directed against cancer cells.

Thus, according to an additional aspect of the present invention there is provided a method of treating cancer as recited herein, and/or for promoting immune stimulation by administering to a subject in need thereof an effective amount of any one of the therapeutic agents and/or a pharmaceutical composition comprising any of the therapeutic agents and further comprising a pharmaceutically acceptable diluent or carrier.

According to at least some embodiments, immune cells, preferably T cells, can be contacted in vivo or ex vivo with the therapeutic agents to modulate immune responses. The T cells contacted with the therapeutic agents can be any cell which expresses the T cell receptor, including α/β and γ/δ T cell receptors. T-cells include all cells which express CD3, including T-cell subsets which also express CD4 and CD8. T-cells include both naive and memory cells and effector cells such as CD8+ cytotoxic T lymphocytes (CTL). T-cells also include cells such as Th1, Tc1, Th2, Tc2, Th3, Th9, Th17, Th22, Treg, follicular helper cells ($T_{FH}$) and Tr1 cells. T-cells also include NKT-cells iNKT, α/β NKT and γ/δ NKT cells, and similar unique classes of the T-cell lineage.

PVRIG blocking antibodies can also be used in combination with bispecific antibodies that target Fcα or Fcγ receptor-expressing effectors cells to tumor cells (see, e.g., U.S. Pat. Nos. 5,922,845 and 5,837,243). Bispecific antibodies can be used to target two separate antigens. For example anti-Fc receptor/anti-tumor antigen (e.g., Her-2/neu) bispecific antibodies have been used to target macrophages to sites of tumor. This targeting may more effectively activate tumor specific responses. The T cell arm of these responses would be augmented by the use of PVRIG blockade. Alternatively, antigen may be delivered directly to DCs by the use of bispecific antibodies which bind to tumor antigen and a dendritic cell specific cell surface marker.

Tumors evade host immune surveillance by a large variety of mechanisms. Many of these mechanisms may be overcome by the inactivation of proteins which are expressed by the tumors and which are immunosuppressive. These include among others TGF-β (Kehrl, J. et al. (1986) *J. Exp. Med.* 163: 1037-1050), IL-10 (Howard, M. & O'Garra, A. (1992) *Immunology Today* 13: 198-200), and Fas ligand (Hahne, M. et al. (1996) *Science* 274: 1363-1365). Antibodies to each of these entities may be used in combination with anti-PVRIG to counteract the effects of the immunosuppressive agent and favor tumor immune responses by the host.

Other antibodies which may be used to activate host immune responsiveness can be used in combination with anti-PVRIG. These include molecules on the surface of dendritic cells which activate DC function and antigen presentation. Anti-CD40 antibodies are able to substitute effectively for T cell helper activity (Ridge, J. et al. (1998) *Nature* 393: 474-478) and can be used in conjunction with PVRIG antibodies (Ito, N. et al. (2000) *Immunobiology* 201 (5) 527-40). Activating antibodies to T cell costimulatory molecules such as OX-40 (Weinberg, A. et al. (2000) *Immunol* 164: 2160-2169), 4-1BB (Melero, I. et al. (1997) *Nature Medicine* 3: 682-685 (1997), and ICOS (Hutloff, A. et al. (1999) *Nature* 397: 262-266) as well as antibodies which block the activity of negative costimulatory molecules such as CTLA-4 (e.g., U.S. Pat. No. 5,811,097, implimumab) or BTLA (Watanabe, N. et al. (2003) *Nat Immunol* 4:670-9), B7-H4 (Sica, G L et al. (2003) *Immunity* 18:849-61) PD-1 (may also provide for increased levels of T cell activation.

Bone marrow transplantation is currently being used to treat a variety of tumors of hematopoietic origin. While graft versus host disease is a consequence of this treatment, therapeutic benefit may be obtained from graft vs. tumor responses. PVRIG blockade can be used to increase the effectiveness of the donor engrafted tumor specific T cells.

There are also several experimental treatment protocols that involve ex vivo activation and expansion of antigen specific T cells and adoptive transfer of these cells into recipients in order to antigen-specific T cells against tumor (Greenberg, R. & Riddell, S. (1999) *Science* 285: 546-51). These methods may also be used to activate T cell responses to infectious agents such as CMV. Ex vivo activation in the presence of anti-PVRIG immune molecules may be expected to increase the frequency and activity of the adoptively transferred T cells.

Optionally, antibodies to PVRIG can be combined with an immunogenic agent, such as cancerous cells, purified tumor antigens (including recombinant proteins, peptides, and carbohydrate molecules), cells, and cells transfected with genes encoding immune stimulating cytokines (He et al (2004) *J. Immunol.* 173:4919-28). Non-limiting examples of tumor vaccines that can be used include peptides of MUC1 for treatment of colon cancer, peptides of MUC-1/CEA/TRI-COM for the treatment of ovary cancer, or tumor cells transfected to express the cytokine GM-CSF (discussed further below).

In humans, some tumors have been shown to be immunogenic such as RCC. It is anticipated that by raising the threshold of T cell activation by PVRIG blockade, we may expect to activate tumor responses in the host.

PVRIG blockade is likely to be most effective when combined with a vaccination protocol. Many experimental strategies for vaccination against tumors have been devised (see Rosenberg, S., 2000, Development of Cancer Vaccines, *ASCO Educational Book Spring:* 60-62; Logothetis, C., 2000, *ASCO Educational Book Spring:* 300-302; Khayat, D. 2000, *ASCO Educational Book Spring:* 414-428; Foon, K. 2000, ASCO Educational Book Spring: 730-738; see also Restifo, N. and Sznol, M., *Cancer Vaccines*, Ch. 61, pp. 3023-3043 in DeVita, V. et al. (eds.), 1997, *Cancer: Principles and Practice of Oncology. Fifth Edition*). In one of these strategies, a vaccine is prepared using autologous or allogeneic tumor cells. These cellular vaccines have been shown to be most effective when the tumor cells are transduced to express GM-CSF. GM-CSF has been shown to be a potent activator of antigen presentation for tumor vaccination (Dranoff et al. (1993) *Proc. Natl. Acad. Sci U.S.A.* 90: 3539-43).

The study of gene expression and large scale gene expression patterns in various tumors has led to the definition of so-called tumor specific antigens (Rosenberg, S A (1999) *Immunity* 10: 281-7). In many cases, these tumor specific antigens are differentiation antigens expressed in the tumors and in the cell from which the tumor arose, for example melanocyte antigens gp100, MAGE antigens, and Trp-2. More importantly, many of these antigens can be shown to be the targets of tumor specific T cells found in the host. PVRIG blockade may be used in conjunction with a collection of recombinant proteins and/or peptides expressed in a tumor in order to generate an immune response to these proteins. These proteins are normally viewed by the immune system as self-antigens and are therefore tolerant to them. The tumor antigen may also include the protein telomerase, which is required for the synthesis of telomeres of chromosomes and which is expressed in more than 85% of human cancers and in only a limited number of somatic tissues (Kim, N et al. (1994) *Science* 266: 2011-2013). (These somatic tissues may be protected from immune attack by various means). Tumor antigen may also be "neo-antigens" expressed in cancer cells because of somatic mutations that alter protein sequence or create fusion proteins between two unrelated sequences (i.e. bcr-ab1 in the Philadelphia chromosome), or idiotype from B cell tumors.

Other tumor vaccines may include the proteins from viruses implicated in human cancers such a Human Papilloma Viruses (HPV), Hepatitis Viruses (HBV and HCV) and Kaposi's Herpes Sarcoma Virus (KHSV). Another form of tumor specific antigen which may be used in conjunction with PVRIG blockade is purified heat shock proteins (HSP) isolated from the tumor tissue itself. These heat shock proteins contain fragments of proteins from the tumor cells and these HSPs are highly efficient at delivery to antigen presenting cells for eliciting tumor immunity (Suot, R & Srivastava, P (1995) *Science* 269:1585-1588; Tamura, Y. et al. (1997) *Science* 278:117-120).

Dendritic cells (DC) are potent antigen presenting cells that can be used to prime antigen-specific responses. DC's can be produced ex vivo and loaded with various protein and peptide antigens as well as tumor cell extracts (Nestle, F. et al. (1998) *Nature Medicine* 4: 328-332). DCs may also be transduced by genetic means to express these tumor antigens as well. DCs have also been fused directly to tumor cells for the purposes of immunization (Kugler, A. et al. (2000) *Nature Medicine* 6:332-336). As a method of vaccination, DC immunization may be effectively combined with PVRIG blockade to activate more potent anti-tumor responses.

Use of the therapeutic agents according to at least some embodiments of the invention as adjuvant for cancer vaccination:

Immunization against tumor-associated antigens (TAAs) is a promising approach for cancer therapy and prevention, but it faces several challenges and limitations, such as tolerance mechanisms associated with self-antigens expressed by the tumor cells. Costimulatory molecules such as B7.1 (CD80) and B7.2 (CD86) have improved the efficacy of gene-based and cell-based vaccines in animal models and are under investigation as adjuvant in clinical trials. This adjuvant activity can be achieved either by enhancing the costimulatory signal or by blocking inhibitory signal that is transmitted by negative costimulators expressed by tumor cells (Neighbors et al., 2008 *J Immunother.*;31(7):644-55).

According to at least some embodiments of the invention, any one of polyclonal or monoclonal antibody and/or antigen-binding fragments and/or conjugates containing same, and/or alternative scaffolds, specific to any one of PVRIG proteins, can be used as adjuvant for cancer vaccination. According to at least some embodiments, the invention provides methods for improving immunization against TAAs, comprising administering to a patient an effective amount of any one of polyclonal or monoclonal antibody and/or antigen-binding fragments and/or conjugates containing same, and/or alternative scaffolds, specific to any one of PVRIG proteins.

In some embodiments the invention provides the use of PVRIG antibodies to perform one or more of the following in a subject in need thereof: (a) upregulating pro-inflammatory cytokines; (b) increasing T-cell proliferation and/or expansion; (c) increasing interferon-ɣ or TNF-α production by T-cells; (d) increasing IL-2 secretion; (e) stimulating antibody responses; (f) inhibiting cancer cell growth; (g) promoting antigenic specific T cell immunity; (h) promoting $CD4^+$ and/or $CD8^+$ T cell activation; (i) alleviating T-cell suppression; (j) promoting NK cell activity; (k) promoting apoptosis or lysis of cancer cells; and/or (l) cytotoxic or cytostatic effect on cancer cells.

In other embodiments the invention provides the use of an immunostimulatory antibody, antigen-binding fragment or conjugate thereof according to at least some embodiments of the invention (optionally in a pharmaceutical composition) to antagonize at least one immune inhibitory effect of the PVRIG.

Such an antibody, antigen-binding fragment or conjugate thereof optionally and preferably mediates at least one of the following effects:

(i) increases in immune response, (ii) increases in activation of $\alpha\beta$ and/or $\gamma\delta$ T cells, (iii) increases in cytotoxic T cell activity, (iv) increases in NK and/or NKT cell activity, (v) alleviation of $\alpha\beta$ and/or $\gamma\delta$ T-cell suppression, (vi) increases in pro-inflammatory cytokine secretion, (vii) increases in IL-2 secretion; (viii) increases in interferon-$\gamma$ production, (ix) increases in Th1 response, (x) decreases in Th2 response, (xi) decreases or eliminates cell number and/or activity of at least one of regulatory T cells (Tregs).

3. Assessment of Treatment

Generally the anti-PVRIG antibodies of the invention are administered to patients with cancer, and efficacy is assessed, in a number of ways as described herein. Thus, while standard assays of efficacy can be run, such as cancer load, size of tumor, evaluation of presence or extent of metastasis, etc., mmuno-oncology treatments can be assessed on the basis of immune status evaluations as well. This can be done in a number of ways, including both in vitro and in vivo assays. For example, evaluation of changes in immune status (e.g. presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on CD4$^+$ T cell activation or proliferation, CD8$^+$ T (CTL) cell activation or proliferation, CD8$^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-$\gamma$ or TNF-$\alpha$ production by T or other immune cells.

In some embodiments, assessment of treatment is done by evaluating immune cell proliferation, using for example, CFSE dilution method, Ki67 intracellular staining of immune effector cells, and 3H-Thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art. See for example Goodkind et al., Computers and Chem. Eng. 29(3):589 (2005), Han et al., Bioinform. Biol. Insights Nov. 15, 2015 9(Suppl. 1):29-46, Campo et al., Nod. Pathol. 2013 January; 26 suppl. 1:S97-S110, the gene expression measurement techniques of which are expressly incorporated by reference herein.

In general, protein expression measurements are also similarly done as is known in the art, see for example, Wang et al., Recent Advances in Capillary Electrophoresis-Based Proteomic Techniques for Biomarker Discovery, Methods. Mol. Biol. 2013:984:1-12; Taylor et al, BioMed Res. Volume 2014, Article ID 361590, 8 pages, Becerk et al., Mutat. Res 2011 Jun. 17:722(2): 171-182, the measurement techniques of which are expressly incorporated herein by reference.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFN$\gamma$, TNF$\alpha$, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of $\alpha\beta$ and/or $\gamma\delta$ T cells, (iii) increases in cytotoxic T cell activity, (iv) increases in NK and/or NKT cell activity, (v) alleviation of $\alpha\gamma$ and/or $\gamma\delta$ T-cell suppression, (vi) increases in pro-inflammatory cytokine secretion, (vii) increases in IL-2 secretion; (viii) increases in interferon-$\gamma$ production, (ix) increases in Th1 response, (x) decreases in Th2 response, (xi) decreases or eliminates cell number and/or activity of at least one of regulatory T cells (Tregs.

Assays to Measure Efficacy

In some embodiments, T cell activation is assessed using a Mixed Lymphocyte Reaction (MLR) assay as is described in EXAMPLE 23. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of $\alpha\beta$ and/or $\gamma\delta$ T cells as measured for an example by cytokine secretion or by proliferation or by changes in expression of activation markers like for an example CD137, CD107$\alpha$, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFN$\gamma$, TNF-$\alpha$, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFN$\gamma$ and TNF), and cell surface receptor expression (e.g. CD25) would be indicative of immune modulation that would be consistent with enhanced killing of cancer cells.

In one embodiment, $\gamma\delta$ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Similarly, increases of at least one-, two-, three-, four- or five-fold as compared to reference or control samples show efficacy.

4. Treatment of Pathogen Infections

According to at least some embodiments, anti-PVRIG antibodies may optionally be used for treating infectious disease, for the same reasons that cancer can be treated: chronic infections are often characterized by varying degrees of functional impairment of virus-specific T-cell responses, and this defect is a principal reason for the inability of the host to eliminate the persisting pathogen. Although functional effector T cells are initially generated during the early stages of infection, they gradually lose function during the course of the chronic infection as a result of persistent exposure to foreign antigen, giving rise to T cell exhaustion. Exhausted T cells express high levels of multiple co-inhibitory receptors such as CTLA-4, PD-1, and LAG3 (Crawford et al., *Curr Opin Immunol.* 2009; 21:179-186; Kaufmann et al., *J Immunol* 2009; 182:5891-5897, Sharpe et al., *Nat Immunol* 2007; 8:239-245). PD-1 overexpression by exhausted T cells was observed clinically in patients suffering from chronic viral infections including HIV, HCV and HBV (Crawford et al., *Curr Opin Immunol* 2009; 21:179-186; Kaufmann et al., *J Immunol* 2009; 182: 5891-5897, Sharpe et al., *Nat Immunol* 2007; 8:239-245). There has been some investigation into this pathway in additional pathogens, including other viruses, bacteria, and parasites (Hofmeyer et al., *J Biomed Biotechnol.* Vol 2011, Art. ID 451694, Bhadra et al., *Proc Natl. Acad Sci.* 2011; 108(22):9196-201). For example, the PD-1 pathway was shown to be involved in controlling bacterial infection using a sepsis model induced by the standard cecal ligation and puncture method. The absence of PD-1 in knockout mice protected from sepsis-induced death in this model (Huang et al., *PNAS* 2009: 106; 6303-6308).

T cell exhaustion can be reversed by blocking co-inhibitory pathways such as PD-1 or CTLA-4 (Rivas et al., *J Immunol.* 2009; 183:4284-91; Golden-Mason et al., *J Virol.* 2009; 83:9122-30; Hofmeyer et al., *J Biomed Biotechnol. Vol* 2011, Art. ID 451694), thus allowing restoration of anti-viral immune function. The therapeutic potential of co-inhibition blockade for treating viral infection was extensively studied by blocking the PD-1/PD-L1 pathway, which was shown to be efficacious in several animal models of infection including acute and chronic simian immunodeficiency virus (SIV) infection in rhesus macaques (Valu et al., *Nature* 2009; 458:206-210) and in mouse models of chronic viral infection, such as lymphocytic choriomeningitis virus (LCMV) (Barber et al., *Nature.* 2006; 439:682-7), and Theiler's murine encephalomyelitis virus (TMEV) model in SJL/J mice (Duncan and Miller *PLoS One.* 2011; 6:e18548). In these models PD-1/PD-L1 blockade improved anti-viral responses and promoted clearance of the persisting viruses. In addition, PD-1/PD-L1 blockade increased the humoral immunity manifested as elevated production of specific anti-virus antibodies in the plasma, which in combination with the improved cellular responses leads to decrease in plasma viral loads and increased survival.

As used herein the term "infectious disorder and/or disease" and/or "infection", used interchangeably, includes any disorder, disease and/or condition caused by presence and/or growth of pathogenic biological agent in an individual host organism. As used herein the term "infection" comprises the disorder, disease and/or condition as above, exhibiting clinically evident illness (i.e., characteristic medical signs and/or symptoms of disease) and/or which is asymtomatic for much or all of it course. As used herein the term "infection" also comprises disorder, disease and/or condition caused by persistence of foreign antigen that lead to exhaustion T cell phenotype characterized by impaired functionality which is manifested as reduced proliferation and cytokine production. As used herein the term "infectious disorder and/or disease" and/or "infection", further includes any of the below listed infectious disorders, diseases and/or conditions, caused by a bacterial infection, viral infection, fungal infection and/or parasite infection.

Anti-PVRIG antibodies can be administered alone or in combination with one or more additional therapeutic agents used for treatment of bacterial infections, viral infection, fungal infections, optionally as described herein.

That is, an infected subject is administered an anti-PVRIG antibodies that antagonizes at least one PVRIG mediated effect on immunity, e.g., its inhibitory effect on cytotoxic T cells or NK activity and/or its inhibitory effect on the production of proinflammatory cytokines, or inhibits the stimulatory effect of PVRIG on TRegs thereby prompting the depletion or killing of the infected cells or the pathogen, and potentially resulting in disease remission based on enhanced killing of the pathogen or infected cells by the subject's immune cells.

5. Treatment of Sepsis

According to at least some embodiments, anti-PVRIG antibodies be used for treating sepsis. As used herein, the term "sepsis" or "sepsis related condition" encompasses Sepsis, Severe sepsis, Septic shock, Systemic inflammatory response syndrome (SIRS), Bacteremia, Septicemia, Toxemia, Septic syndrome.

Upregulation of inhibitory proteins has lately emerged as one of the critical mechanisms underlying the immunosuppression in sepsis. The PD-1/PDL-1 pathway, for example, appears to be a determining factor of the outcome of sepsis, regulating the delicate balance between effectiveness and damage by the antimicrobial immune response. During sepsis in an experimental model, peritoneal macrophages and blood monocytes markedly increased PD-1 levels, which was associated with the development of cellular dysfunction (Huang et al 2009 PNAS 106:6303-6308). Similarly, in patients with septic shock the expression of PD-1 on peripheral T cells and of PDL-1 on monocytes was dramatically upregulated (Zhang et al 2011 Crit. Care 15:R70). Recent animal studies have shown that blockade of the PD-1/PDL-1 pathway by anti-PD1 or anti-PDL1 antibodies improved survival in sepsis (Brahmamdam et al 2010 J. Leukoc. Biol. 88:233-240; Zhang et al 2010 Critical Care 14:R220; Chang et al 2013 Critical Care 17:R85). Similarly, blockade of CTLA-4 with anti-CTLA4 antibodies improved survival in sepsis (Inoue et al 2011 Shock 36:38-44; Chang et al 2013 Critical Care 17:R85). Taken together, these findings suggest that blockade of inhibitory proteins, including negative costimulatory molecules, is a potential therapeutic approach to prevent the detrimental effects of sepsis (Goyert and Silver, J Leuk. Biol., 88(2): 225-226, 2010).

According to some embodiments, the invention provides treatment of sepsis using anti-PVRIG antibodies, either alone or in combination with known therapeutic agent effective for treating sepsis, such as those therapies that block the cytokine storm in the initial hyperinflammatory phase of sepsis, and/or with therapies that have immunostimulatory effect in order to overcome the sepsis-induced immunosuppression phase.

Combination with standard of care treatments for sepsis, as recommended by the "International Guidelines for Management of Severe Sepsis and Septic Shock" (Dellinger et al 2013 Intensive Care Med 39:165-228), some of which are described below.

Broad spectrum antibiotics having activity against all likely pathogens (bacterial and/or fungal—treatment starts when sepsis is diagnosed, but specific pathogen is not identified)—example Cefotaxime (Claforan®), Ticarcillin and clavulanate (Timentin®), Piperacillin and tazobactam (Zosyn®), Imipenem and cilastatin (Primaxin®), Meropenem (Merrem®), Clindamycin (Cleocin), Metronidazole (Flagyl®), Ceftriaxone (Rocephin®), Ciprofloxacin (Cipro®), Cefepime (Maxipime®), Levofloxacin (Levaquin®), Vancomycin or any combination of the listed drugs.

Vasopressors: example Norepinephrine, Dopamine, Epinephrine, vasopressin

Steroids: example: Hydrocortisone, Dexamethasone, or Fludrocortisone, intravenous or otherwise Inotropic therapy: example Dobutamine for sepsis patients with myocardial dysfunction Recombinant human activated protein C (rhAPC), such as drotrecogin alfa (activated) (DrotAA).

β-blockers additionally reduce local and systemic inflammation.

Metabolic interventions such as pyruvate, succinate or high dose insulin substitutions.

Combination with novel potential therapies for sepsis:

Selective inhibitors of sPLA2-IIA (such as LY315920NA/5-5920). Rationale: The Group IIA secretory phospholipase A2 (sPLA2-IIA), released during inflammation, is increased in severe sepsis, and plasma levels are inversely related to survival.

Phospholipid emulsion (such as GR270773). Rationale: Preclinical and ex vivo studies show that lipoproteins bind and neutralize endotoxin, and experimental animal studies demonstrate protection from septic death when lipoproteins are administered. Endotoxin neutralization correlates with the amount of phospholipid in the lipoprotein particles.

anti-TNF-α antibody: Rationale: Tumor necrosis factor-α (TNF-α) induces many of the pathophysiological signs and symptoms observed in sepsis anti-CD14 antibody (such as IC14). Rationale: Upstream recognition molecules, like CD14, play key roles in the pathogenesis. Bacterial cell wall components bind to CD14 and co-receptors on myeloid cells, resulting in cellular activation and production of proinflammatory mediators. An anti-CD14 monoclonal antibody (IC14) has been shown to decrease lipopolysaccharide-induced responses in animal and human models of endotoxemia.

Inhibitors of Toll-like receptors (TLRs) and their downstream signaling pathways. Rationale: Infecting microbes display highly conserved macromolecules (e.g., lipopolysaccharides, peptidoglycans) on their surface. When these macromolecules are recognized by pattern-recognition receptors (called Toll-like receptors [TLRs]) on the surface of immune cells, the host's immune response is initiated. This may contribute to the excess systemic inflammatory response that characterizes sepsis. Inhibition of several TLRs is being evaluated as a potential therapy for sepsis, in particular TLR4, the receptor for Gram-negative bacteria outer membrane lipopolysaccharide or endotoxin. Various drugs targeting TLR4 expression and pathway have a therapeutic potential in sepsis (Wittebole et al 2010 Mediators of Inflammation Vol 10 Article ID 568396). Among these are antibodies targeting TLR4, soluble TLR4, Statins (such as Rosuvastatin®, Simvastatin®), Ketamine, nicotinic analogues, eritoran (E5564), resatorvid (TAK242). In addition, antagonists of other TLRs such as chloroquine, inhibition of TLR-2 with a neutralizing antibody (anti-TLR-2).

Lansoprazole through its action on SOCS 1 (suppressor of cytokine secretion)

Talactoferrin or Recombinant Human Lactoferrin. Rationale: Lactoferrin is a glycoprotein with anti-infective and anti-inflammatory properties found in secretions and immune cells. Talactoferrin alfa, a recombinant form of human lactoferrin, has similar properties and plays an important role in maintaining the gastrointestinal mucosal barrier integrity. Talactoferrin showed efficacy in animal models of sepsis, and in clinical trials in patients with severe sepsis (Guntupalli et al Crit Care Med. 2013; 41(3):706-716).

Milk fat globule EGF factor VIII (MFG-E8)—a bridging molecule between apoptotic cells and phagocytes, which promotes phagocytosis of apoptotic cells.

Agonists of the 'cholinergic anti-inflammatory pathway', such as nicotine and analogues. Rationale: Stimulating the vagus nerve reduces the production of cytokines, or immune system mediators, and blocks inflammation. This nerve "circuitry", called the "inflammatory reflex", is carried out through the specific action of acetylcholine, released from the nerve endings, on the α7 subunit of the nicotinic acetylcholine receptor (α7nAChR) expressed on macrophages, a mechanism termed 'the cholinergic anti-inflammatory pathway'. Activation of this pathway via vagus nerve stimulation or pharmacologic α7 agonists prevents tissue injury in multiple models of systemic inflammation, shock, and sepsis (Matsuda et al 2012 J Nippon Med Sch. 79:4-18; Huston 2012 Surg. Infect. 13:187-193).

Therapeutic agents targeting the inflammasome pathways. Rationale: The inflammasome pathways greatly contribute to the inflammatory response in sepsis, and critical elements are responsible for driving the transition from localized inflammation to deleterious hyperinflammatory host response (Cinel and Opal 2009 Crit. Care Med. 37:291-304; Matsuda et al 2012 J Nippon Med Sch. 79:4-18).

Stem cell therapy. Rationale: Mesenchymal stem cells (MSCs) exhibit multiple beneficial properties through their capacity to home to injured tissue, activate resident stem cells, secrete paracrine signals to limit systemic and local inflammatory response, beneficially modulate immune cells, promote tissue healing by decreasing apoptosis in threatened tissues and stimulating neoangiogenesis, and exhibit direct antimicrobial activity. These effects are associated with reduced organ dysfunction and improved survival in sepsis animal models, which have provided evidence that MSCs may be useful therapeutic adjuncts (Wannemuehler et al 2012 J. Surg. Res. 173:113-26).

Combination of anti-PVRIG antibody with other immunomodulatory agents, such as immunostimulatory antibodies, cytokine therapy, immunomodulatory drugs. Such agents bring about increased immune responsiveness, especially in situations in which immune defenses (whether innate and/or adaptive) have been degraded, such as in sepsis-induced hypoinflammatory and immunosuppressive condition. Reversal of sepsis-induced immunoparalysis by therapeutic agents that augments host immunity may reduce the incidence of secondary infections and improve outcome in patients who have documented immune suppression (Hotchkiss et al 2013 Lancet Infect. Dis. 13:260-268; Payen et al 2013 Crit Care. 17:118).

Immunostimulatory antibodies promote immune responses by directly modulating immune functions, i.e. blocking other inhibitory proteins or by enhancing costimulatory proteins. Experimental models of sepsis have shown that immunostimulation by antibody blockade of inhibitory proteins, such as PD-1, PDL-1 or CTLA-4 improved survival in sepsis (Brahmamdam et al 2010 J. Leukoc. Biol. 88:233-240; Zhang et al 2010 Critical Care 14:R220; Chang et al 2013 Critical Care 17:R85; Inoue et al 2011 Shock 36:38-44), pointing to such immunostimulatory agents as potential therapies for preventing the detrimental effects of sepsis-induced immunosuppression (Goyert and Silver J Leuk. Biol. 88(2):225-226, 2010). Immunostimulatory antibodies include: 1) Antagonistic antibodies targeting inhibitory immune checkpoints include anti-CTLA4 mAbs (such as ipilimumab, tremelimumab), Anti-PD-1 (such as nivolumab BMS-936558/MDX-1106/ONO-4538, AMP224, CT-011, lambrozilumab MK-3475), Anti-PDL-1 antagonists (such as BMS-936559/MDX-1105, MEDI4736, RG-7446/MPDL3280A); Anti-LAG-3 such as IMP-321), Anti-TIM-3, Anti-BTLA, Anti-B7-H4, Anti-B7-H3, anti-VISTA. 2) Agonistic antibodies enhancing immunostimulatory proteins include Anti-CD40 mAbs (such as CP-870,893, lucatumumab, dacetuzumab), Anti-CD137 mAbs (such as BMS-663513 urelumab, PF-05082566), Anti-OX40 mAbs (such as Anti-OX40), Anti-GITR mAbs (such as TRX518), Anti-CD27 mAbs (such as CDX-1127), and Anti-ICOS mAbs.

Cytokines which directly stimulate immune effector cells and enhance immune responses can be used in combination with anti-GEN antibody for sepsis therapy: IL-2, IL-7, IL-12, IL-15, IL-17, IL-18 and IL-21, IL-23, IL-27, GM-CSF, IFNα (interferon α), IFNβ, IFNγ. Rationale: Cytokine-based therapies embody a direct attempt to stimulate the patient's own immune system. Experimental models of sepsis have shown administration of cytokines, such as IL-7 and IL-15, promote T cell viability and result in improved survival in sepsis (Unsinger et al 2010 J. Immunol. 184: 3768-3779; Inoue et al 2010 J. Immunol. 184:1401-1409). Interferon-ɣ (IFNγ) reverses sepsis-induced immunoparalysis of monocytes in vitro. An in vivo study showed that IFNγ partially reverses immunoparalysis in vivo in humans. IFNγ and granulocyte-macrophage colony-stimulating factor (GM-CSF) restore immune competence of ex vivo stimulated leukocytes of patients with sepsis (Mouktaroudi et al Crit Care. 2010; 14: P17; Leentjens et al Am J Respir Crit Care Med Vol 186, pp 838-845, 2012).

Immunomodulatory drugs such as thymosin α1. Rationale: Thymosin α1 (Tα1) is a naturally occurring thymic peptide which acts as an endogenous regulator of both the innate and adaptive immune systems. It is used worldwide for treating diseases associated with immune dysfunction including viral infections such as hepatitis B and C, certain cancers, and for vaccine enhancement. Notably, recent development in immunomodulatory research has indicated the beneficial effect of Tα1 treatment in septic patients (Wu et al. Critical Care 2013, 17:R8).

In the above-described sepsis therapies preferably a subject with sepsis or at risk of developing sepsis because of a virulent infection, e.g., one resistant to antibiotics or other drugs, will be administered an immunostimulatory anti-PVRIG antibody or antigen-binding fragment according to the invention, which antibody antagonizes at least one PVRIG mediated effect on immunity, e.g., its inhibitory effect on cytotoxic T cells or NK activity and/or its inhibitory effect on the production of proinflammatory cytokines, or inhibits the stimulatory effect of PVRIG on TRegs thereby promoting the depletion or killing of the infected cells or the pathogen, and potentially resulting in disease remission based on enhanced killing of the pathogen or infected cells by the subject's endogenous immune cells. Because sepsis may rapidly result in organ failure, in this embodiment it may be beneficial to administer anti-PVRIG antibody fragments such as Fabs rather than intact antibodies as they may reach the site of sepsis and infection quicker than intact antibodies. In such treatment regimens antibody half-life may be of lesser concern due to the sometimes rapid morbidity of this disease.

B. Diagnostic Uses

The anti-PVRIG antibodies provided also find use in the in vitro or in vivo diagnosis, including imaging, of tumors that over-express PVRIG. It should be noted, however, that as discussed herein, PVRIG, as an immuno-oncology target protein, is not necessarily overexpressed on cancer cells rather within the immune infiltrates in the cancer. In some instances it is; rather, the mechanism of action, activation of immune cells such as T cells and NK cells, that results in cancer diagnosis. Accordingly, anti-PVRIG antibodies can be used to diagnose cancer.

In particular, immune cells infiltrating the tumors that over express PVRIG, and thus can be diagnosed by anti-PVRIG antibodies, include, but are not limited to, prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma and esophageal cancer.

Generally, diagnosis can be done in several ways. In one embodiment, a tissue from a patient, such as a biopsy sample, is contacted with a PVRIG antibody, generally labeled, such that the antibody binds to the endogenous PVRIG. The level of signal is compared to that of normal non-cancerous tissue either from the same patient or a reference sample, to determine the presence or absence of cancer. The biopsy sample can be from a solid tumor, a blood sample (for lymphomas and leukemias such as ALL, T cell lymphoma, etc).

In general, in this embodiment, the anti-PVRIG is labeled, for example with a fluorophore or other optical label, that is detected using a fluorometer or other optical detection system as is well known in the art. In an alternate embodiment, a secondary labeled antibody is contacted with the sample, for example using an anti-human IgG antibody from a different mammal (mouse, rat, rabbit, goat, etc.) to form a sandwich assay as is known in the art. Alternatively, the anti-PVRIG mAb could be directly labeled (i.e. biotin) and detection can be done by a secondary Ab directed to the labeling agent in the art.

Once over-expression of PVRIG is seen, treatment can proceed with the administration of an anti-PVRIG antibody according to the invention as outlined herein.

In other embodiments, in vivo diagnosis is done. Generally, in this embodiment, the anti-PVRIG antibody (including antibody fragments) is injected into the patient and imaging is done. In this embodiment, for example, the antibody is generally labeled with an optical label or an MRI label, such as a gadolinium chelate, radioactive labeling of mAb (including fragments).

In some embodiments, the antibodies described herein are used for both diagnosis and treatment, or for diagnosis alone. When anti-PVRIG antibodies are used for both diagnosis and treatment, some embodiments rely on two different anti-PVRIG antibodies to two different epitopes, such that the diagnostic antibody does not compete for binding with the therapeutic antibody, although in some cases the same antibody can be used for both. For example, this can be done using antibodies that are in different bins, e.g. that bind to different epitopes on PVRIG, such as outlined herein. Thus included in the invention are compositions comprising a diagnostic antibody and a therapeutic antibody, and in some embodiments, the diagnostic antibody is labeled as described herein. In addition, the composition of therapeutic and diagnostic antibodies can also be co-administered with other drugs as outlined herein.

Particularly useful antibodies for use in diagnosis include, but are not limited to these enumerated antibodies, or antibodies that utilize the CDRs with variant sequences, or those that compete for binding with any of CPA.7.001 to CPA.7.050, and in particular, those that both bind PVRIG and block receptor binding, including, CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, and CPA.7.050. In addition, those that bind but do not block can also be used, including CPA.7.016, CPA.7.020, CPA.7.028, CPA.7.030, CPA.7.038, CPA.7.044 and CPA.7.045.

As will be appreciated by those in the art, for ex vivo or in vitro assays, murine antibodies can be used, and thus the variable heavy and light domains from any of the following can be used for diagnosis, including the CDR sets in other formats, from CHA.7.502, CHA.7.503, CHA.7.506, CHA.7.508, CHA.7.510, CHA.7.512, CHA.7.514, CHA.7.516, CHA.7.518, CHA.7.520.1, CHA.7.520.2, CHA.7.522, CHA.7.524, CHA.7.526, CHA.7.527, CHA.7.528, CHA.7.530, CHA.7.534, CHA.7.535, CHA.7.537, CHA.7.538.1, CHA.7.538.2, CHA.7.543, CHA.7.544, CHA.7.545, CHA.7.546, CHA.7.547, CHA.7.548, CHA.7.549 and CHA.7.550.

In many embodiments, a diagnostic antibody is labeled. By "labeled" herein is meant that the antibodies disclosed herein have one or more elements, isotopes, or chemical compounds attached to enable the detection in a screen or diagnostic procedure. In general, labels fall into several classes: a) immune labels, which may be an epitope incorporated as a fusion partner that is recognized by an antibody, b) isotopic labels, which may be radioactive or heavy isotopes, c) small molecule labels, which may include fluorescent and colorimetric dyes, or molecules such as biotin that enable other labeling methods, and d) labels such as particles (including bubbles for ultrasound labeling) or paramagnetic labels that allow body imagining. Labels may be incorporated into the antibodies at any position and may be incorporated in vitro or in vivo during protein expression, as is known in the art.

Diagnosis can be done either in vivo, by administration of a diagnostic antibody that allows whole body imaging as described below, or in vitro, on samples removed from a patient. "Sample" in this context includes any number of things, including, but not limited to, bodily fluids (including, but not limited to, blood, urine, serum, lymph, saliva, anal and vaginal secretions, perspiration and semen), as well as tissue samples such as result from biopsies of relevant tissues.

In some embodiments, in vivo imaging is done, including but not limited to ultrasound, CT scans, X-rays, MRI and PET scans, as well as optical techniques, such as those using optical labels for tumors near the surface of the body.

In vivo imaging of diseases associated with PVRIG may be performed by any suitable technique. For example, 99Tc-labeling or labeling with another β-ray emitting isotope may be used to label anti-PVRIG antibodies. Variations on this technique may include the use of magnetic resonance imaging (MRI) to improve imaging over gamma camera techniques.

In one embodiment, the present invention provides an in vivo imaging method wherein an anti-PVRIG antibody is conjugated to a detection-promoting agent, the conjugated antibody is administered to a host, such as by injection into the bloodstream, and the presence and location of the labeled antibody in the host is assayed. Through this technique and any other diagnostic method provided herein, the present invention provides a method for screening for the presence of disease-related cells in a human patient or a biological sample taken from a human patient.

For diagnostic imaging, radioisotopes may be bound to an anti-PVRIG antibody either directly, or indirectly by using an intermediary functional group. Useful intermediary functional groups include chelators, such as ethylenediaminetetraacetic acid and diethylenetriaminepentaacetic acid (see for instance U.S. Pat. No. 5,057,313), in such diagnostic assays involving radioisotope-conjugated anti-PVRIG antibodies, the dosage of conjugated anti-PVRIG antibody delivered to the patient typically is maintained at as low a level as possible through the choice of isotope for the best combination of minimum half-life, minimum retention in the body, and minimum quantity of isotope, which will permit detection and accurate measurement.

In addition to radioisotopes and radio-opaque agents, diagnostic methods may be performed using anti-PVRIG antibodies that are conjugated to dyes (such as with the biotin-streptavidin complex), contrast agents, fluorescent compounds or molecules and enhancing agents (e.g. paramagnetic ions) for magnetic resonance imaging (MRI) (see, e.g., U.S. Pat. No. 6,331,175, which describes MRI techniques and the preparation of antibodies conjugated to a MRI enhancing agent). Such diagnostic/detection agents may be selected from agents for use in magnetic resonance imaging, and fluorescent compounds.

In order to load an anti-PVRIG antibody with radioactive metals or paramagnetic ions, it may be necessary to react it with a reagent having a long tail to which are attached a multiplicity of chelating groups for binding the ions. Such a tail may be a polymer such as a polylysine, polysaccharide, or other derivatized or derivatizable chain having pendant groups to which can be bound chelating groups such as, e.g., porphyrins, polyamines, crown ethers, bisthiosemicarbazones, polyoximes, and like groups known to be useful for this purpose.

Chelates may be coupled to anti-PVRIG antibodies using standard chemistries. A chelate is normally linked to an anti-PVRIG antibody by a group that enables formation of a bond to the molecule with minimal loss of immunoreactivity and minimal aggregation and/or internal cross-linking.

Examples of potentially useful metal-chelate combinations include 2-benzyl-DTPA and its monomethyl and cyclohexyl analogs, used with diagnostic isotopes in the general energy range of 60 to 4,000 keV, such as $^{125}I$, $^{123}I$, $^{124}I$, $^{62}Cu$, $^{64}Cu$, $^{18}F$, $^{111}In$, $^{67}Ga$, $^{99}Tc$, $^{94}Tc$, $^{11}C$, $^{13}N$, $^{5}O$, and $^{76}Br$, for radio-imaging.

Labels include a radionuclide, a radiological contrast agent, a paramagnetic ion, a metal, a fluorescent label, a chemiluminescent label, an ultrasound contrast agent and a photoactive agent. Such diagnostic agents are well known and any such known diagnostic agent may be used. Non-limiting examples of diagnostic agents may include a radionuclide such as $^{110}In$, $^{111}In$, $^{177}Lu$, $^{18}F$, $^{52}Fe$, $^{62}Cu$, $^{64}Cu$, $^{67}Cu$, $^{67}Ga$, $^{68}Ga$, $^{86}Y$, $^{90}Y$, $^{89}Zr$, $^{94m}Tc$, $^{94}Tc$, $^{99m}Tc$, $^{120}I$, $^{123}I$, $^{124}I$, $^{125}I$, $^{131}I$, $^{154\text{-}158}Gd$, $^{32}P$, $^{11}C$, $^{13}N$, $^{15}O$, $^{186}Re$, $^{188}Re$, $^{51}Mn$, $^{52m}Mn$, $^{55}Co$, $^{72}As$, $^{75}Br$, $^{76}Br$, $^{82m}Rb$, $^{83}Sr$, or other γ-, β-, or positron-emitters.

Paramagnetic ions of use may include chromium (III), manganese (II), iron (III), iron (II), cobalt (II), nickel (III), copper (III), neodymium (III), samarium (III), ytterbium (III), gadolinium (III), vanadium (II), terbium (III), dysprosium (III), holmium (III) or erbium (III), Metal contrast agents may include lanthanum (III), gold (III), lead (II) or bismuth (III).

Ultrasound contrast agents may comprise liposomes, such as gas filled liposomes. Radiopaque diagnostic agents may be selected from compounds, barium compounds, gallium compounds, and thallium compounds.

These and similar chelates, when complexed with non-radioactive metals, such as manganese, iron, and gadolinium may be useful for MRI diagnostic methods in connection with anti-PVRIG antibodies. Macrocyclic chelates such as NOTA, DOTA, and TETA are of use with a variety of metals and radiometals, most particularly with radionuclides of gallium, yttrium, and copper, respectively. Such metal-chelate complexes may be made very stable by tailoring the ring size to the metal of interest. Other ring-type chelates such as macrocyclic polyethers, which are of interest for stably binding nuclides, such as 223Ra may also be suitable in diagnostic methods.

Thus, the present invention provides diagnostic anti-PVRIG antibody conjugates, wherein the anti-PVRIG antibody conjugate is conjugated to a contrast agent (such as for magnetic resonance imaging, computed tomography, or ultrasound contrast-enhancing agent) or a radionuclide that may be, for example, a γ-, β-, α-, Auger electron-, or positron-emitting isotope.

Anti-PVRIG antibodies may also be useful in, for example, detecting expression of an antigen of interest in specific cells, tissues, or serum. For diagnostic applications, the antibody typically will be labeled with a detectable moiety for in vitro assays. As will be appreciated by those in the art, there are a wide variety of suitable labels for use in in vitro testing. Suitable dyes for use in this aspect of the invention include, but are not limited to, fluorescent lanthanide complexes, including those of Europium and Terbium, fluorescein, rhodamine, tetramethylrhodamine, eosin, erythrosin, coumarin, methyl-coumarins, quantum dots (also referred to as "nanocrystals"; see U.S. Ser. No. 09/315,584, hereby incorporated by reference), pyrene, Malacite green, stilbene, Lucifer Yellow, Cascade Blue™, Texas Red, Cy dyes (Cy3, Cy5, etc.), alexa dyes (including Alexa, phycoerythin, bodipy, and others described in the 6th Edition of the Molecular Probes Handbook by Richard P. Haugland, hereby expressly incorporated by reference.

Stained tissues may then be assessed for radioactivity counting as an indicator of the amount of PVRIG-associated peptides in the tumor. The images obtained by the use of such techniques may be used to assess biodistribution of PVRIG in a patient, mammal, or tissue, for example in the context of using PVRIG as a biomarker for the presence of invasive cancer cells.

EXAMPLES

Reference is made to U.S. Ser. No. 15/048,975, filed Feb. 19, 2016, entitled "PVRIG POLYPEPTIDES AND METHODS OF TREATMENT", claiming priority to USSN to U.S. Ser. No. 62/118,235, filed Feb. 19, 2015, and to U.S. Ser. No. 62/141,168, filed Mar. 31, 2015, all of which are expressly incorporated herein by reference in their entirety.

Example 1: Expression Analysis of PVRIG Proteins

Example 1A

Figure 2:
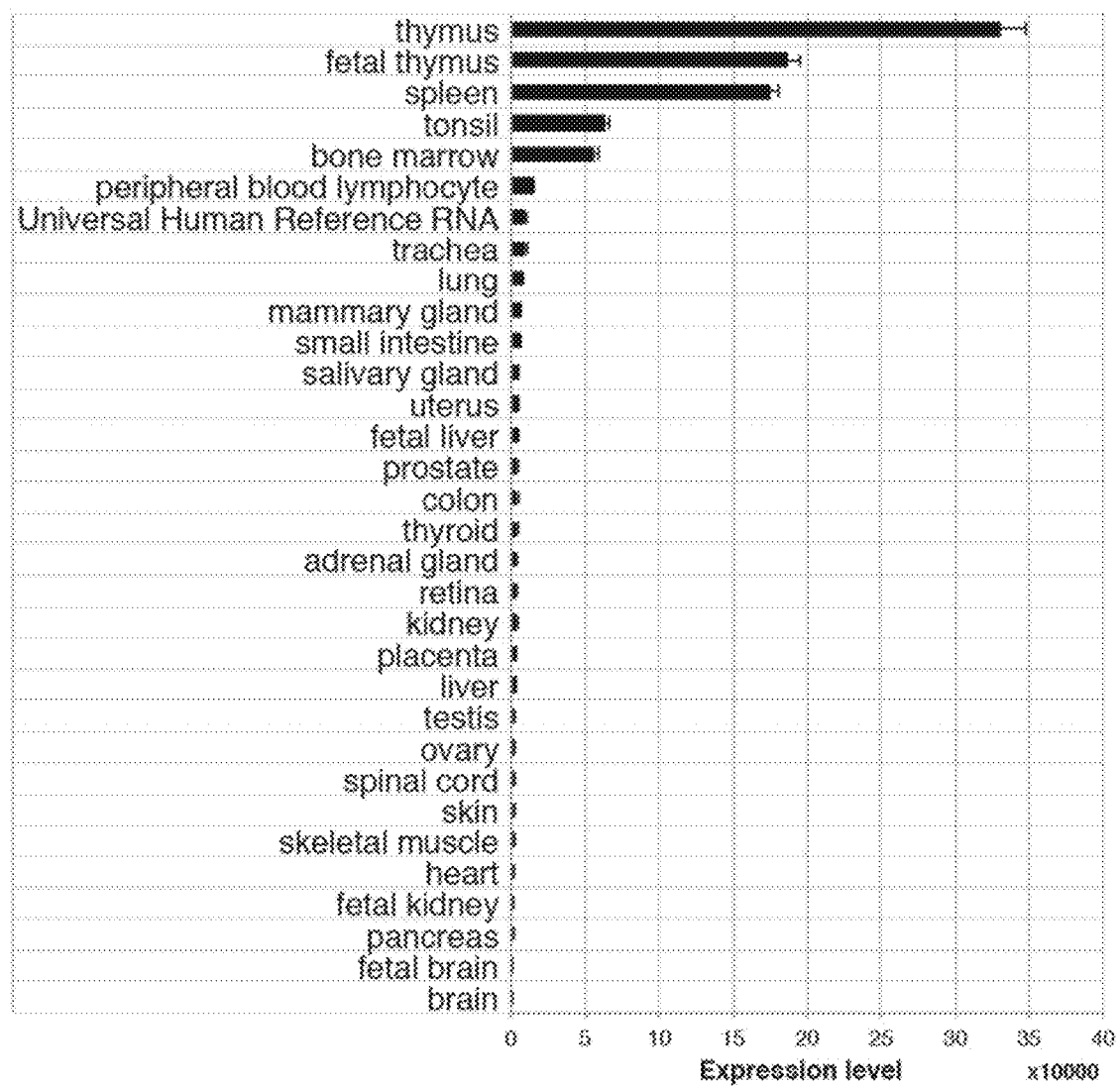
FIG. 2 presents mRNA Expression of PVRIG in various normal human tissues.
Figure 3:
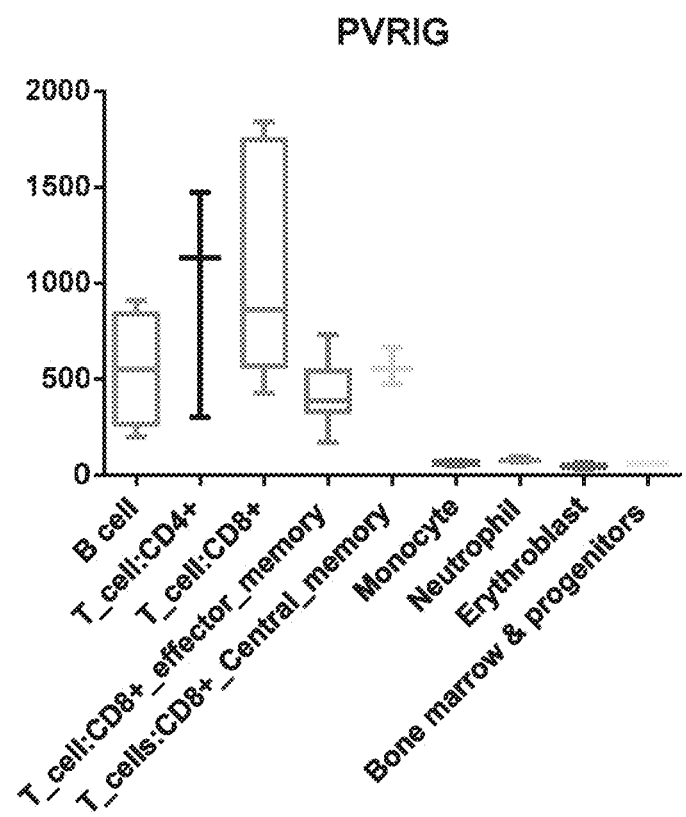
FIG. 3 presents mRNA expression of PVRIG in various immune population derived from peripheral blood and bone marrow (based on GSE49910).
Figure 4:
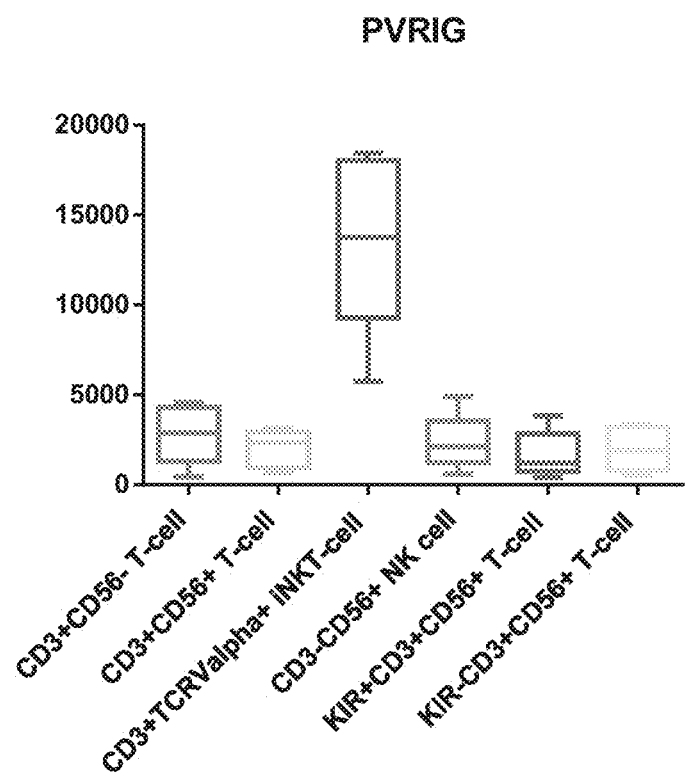
FIG. 4 presents mRNA expression of PVRIG in various CD3+ lymphocyte population (based on GSE47855).

The GDS3113 data set (http://www.ncbi.nlm.nih.gov/sites/GDSbrowser?acc=GDS3113) was analyzed to identify genes with a lymphoid organ specific pattern. PVRIG was identified as lymphocyte specific due to high expression in primary and secondary lymphoid organs, which include peripheral blood, bone marrow, spleen, lymph nodes, tonsil and thymus (FIG. 2). Other tissue types were negative or showed expression at background levels. In order to investigate which specific cell types within the total population of immune cells express PVRIG, additional data sets form the Gene Expression Omnibus (www.ncbi.nlm.nih.gov/GEO) were analyzed, as described in "methodology" section herein. The analysis was performed on immune cell populations derived from peripheral blood and bone marrow. PVRIG was expressed in lymphocytes both in the B-cell lineage and the T-cell lineage including CD8 T-cells naïve, effector and memory (FIG. 3). In addition, PVRIG was expressed in NK cells and had the highest expression in the iNKT population (FIG. 4). The iNKT population of lymphocytes act as potent activators of antitumor immunity when stimulated with a synthetic agonist in experimental models. However, in some settings, iNKT cells can act as suppressors and regulators of antitumor immunity (Clin Dev Immunol. 2012; 2012:720803). Furthermore, in early clinical trials of iNKT cell-based immunotherapy demonstrated that the infusion of ligand-pulsed antigen presenting cells treatment of and/or in vitro activated iNKT cells were safe and well tolerated in lung cancer and head and neck cancer (Clin Immunol. 2011 August; 140(2): 167-76.).

A key question in regards to PVRIG expression was whether Tumor Infiltrating Lymphocytes (TILs) retain expression of PVRIG in the tumor microenvironment. Analyzing expression data of TILs form follicular lymphoma, breast cancer and colon cancer showed clear expression of PVRIG in the TILs infiltrating the tumor. In the colon cancer example the specificity to the immune infiltrating cells was seen as the expression is found only in the CD45 positive population (leukocyte specific marker), and no expression is found in EPCAM positive population (epithelial specific marker) or in the CD45 negative EPCAM negative (stromal cell population). Although the CD45 is not a lymphocyte specific marker, the other expression description infers that it is expressed on the lymphocyte population (FIG. 5A colon cancer, FIG. 5B breast cancer and FIG. 5C follicular lymphoma).

The mRNA expression data shown herein indicates that PVRIG is expressed in lymphocytes and in tumor infiltrating lymphocytes (TILs). These results together with PVRIG inhibitory activity propose an inhibitory role of the molecule in T-cells, suggesting that inhibitory antibodies to PVRIG elevates PVRIG's suppressive role on the TILs and thus enable the TILs to induce an immune response against cancer. As the proposed mechanism of action is directed to the TILs infiltrating the tumor, rather than direct effect on the tumor cells, any cancer with immune infiltration is candidate for treatment using PVRIG inhibitory antibodies.

Methodology:

Raw data is downloaded from the GEO site in SOFT format. In cases where the raw data was in MASS format, the data was taken without manipulation. If the data was in Log MASS then the data was converted to linear data. If the data was in RMA format CEL files (raw data) were downloaded and re-analyzed using MASS. If raw CEL files were not available the RMA format was used.

Data was then normalized by multiplicative according to the 95th percentile for Affy data. Datasets analyzed: GSE49910, GSE47855, GSE39397, GSE36765, GSE27928.

Example 1B

A transcriptome reference was generated based on UCSC know genes models (http://hgdownload.cse.ucsc.edu/goldenPath/hg19/database/knownGene.txt.gz). All RNA sequencing reads were aligned to the transcriptome sequences first. This alignment allowed for non-unique mapping because isoforms share many exons. Each read was then assigned genomic coordinates and exon junctions based on the transcriptome matching. The remaining unmapped reads were aligned directly to the genome by considering one or more exon junctions. Finally, read counts were normalized as described by Bo et al. (Bioinformatics 2010, 26 (4): 493-500) and converted to gene expression values as described by Trapnell et al (Nat Biotechnol. 2010 May; 28(5):511-5).

Figure 6:
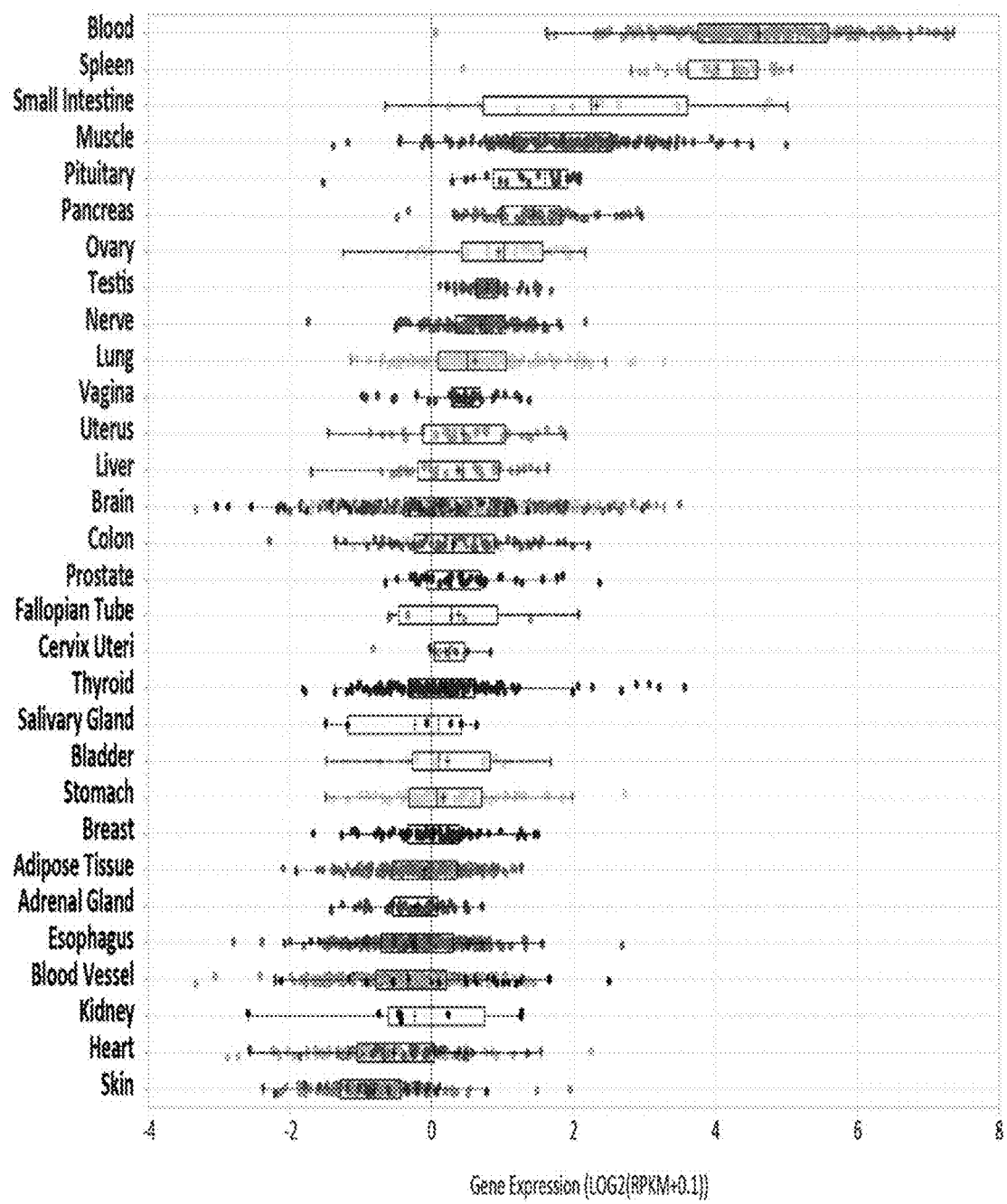
FIG. 6 presents PVRIG expression in normal tissues based on GTEx. Expression levels are shown in log 2(RPKM) values (fragments identified per million reads per kilobase). Values above 1 are considered high expression. Tissues are ranked from top to bottom by the median expression. Each dot on the plot represent a single sample.
Figure 7:
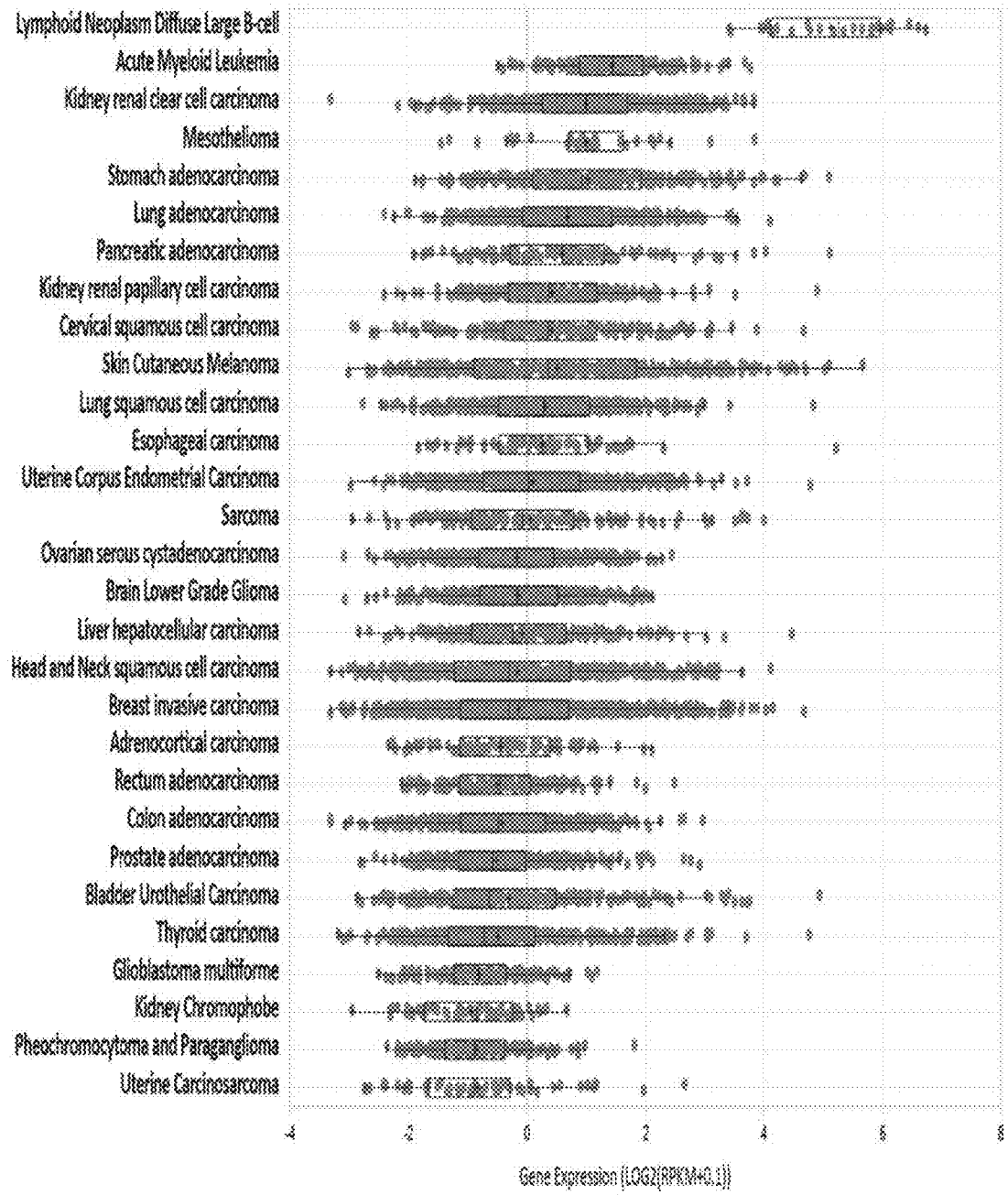
FIG. 7 presents PVRIG expression in cancerous tissues based on TCGA. Expression levels are shown in log 2(RPKM) values (fragments identified per million reads per kilobase). Values above 1 are considered high expression. Tissues are ranked from top to bottom by the median expression. Each dot on the plot represent a single sample

As shown in FIG. 6, based on Genotype-Tissue Expression (GTEx) data (http://www.nature.com/ng/journal/v45/n6/full/ng.2653.html; http://www.gtexportal.org/home/), PVRIG is expressed mainly in blood cells and to lesser extent in various normal tissues. The same results were observed in cancerous tissues from The Cancer Genome Atlas (TCGA) (http://cancergenome.nih.gov/) in which high expression are seen in blood cancers like B-cell lymphomas and AML (FIG. 7). A gene expression signature was generated for a variety of cancers and normal tissues using GTEx and TCGA data by identifying genes with a highly correlated expression pattern to PVRIG.

Figure 8:
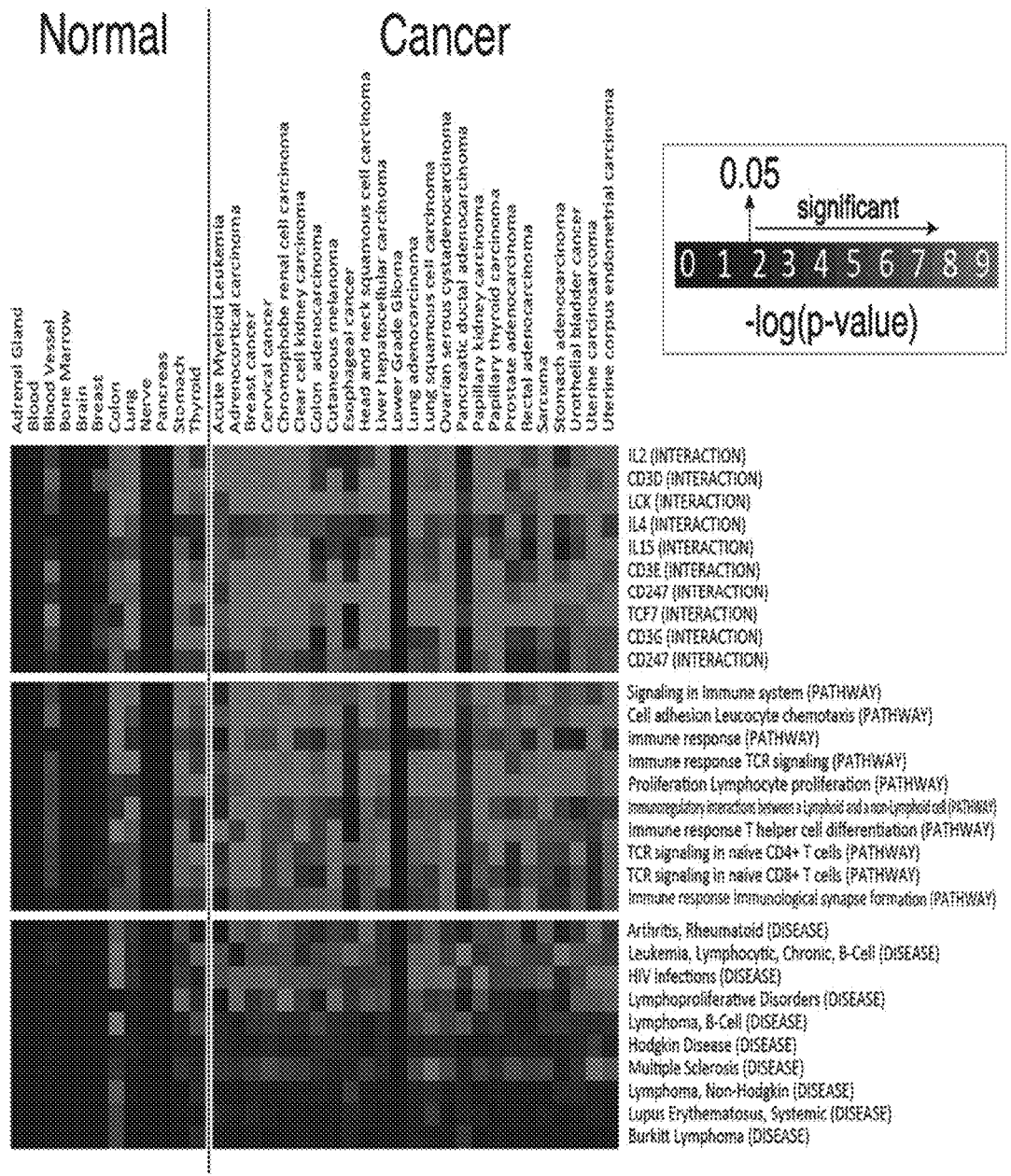
FIG. 8 shows a heatmap representation of the enrichment analysis results in three categories: protein interactions, pathways and disease associations. Results are ranked from top to bottom by average p-value per row. Only the top 10 results from each category are shown. Gray squares indicate p-values<0.05. Each column in the heatmap corresponds to a normal or cancer tissue from which a list of highly correlated genes was derived (r>0.55 using at least 50 samples). As shown in the heatmap, PVRIG correlates with a T cell gene expression signature which is strongly associated with the immune response and immune diseases.
Figure 9:
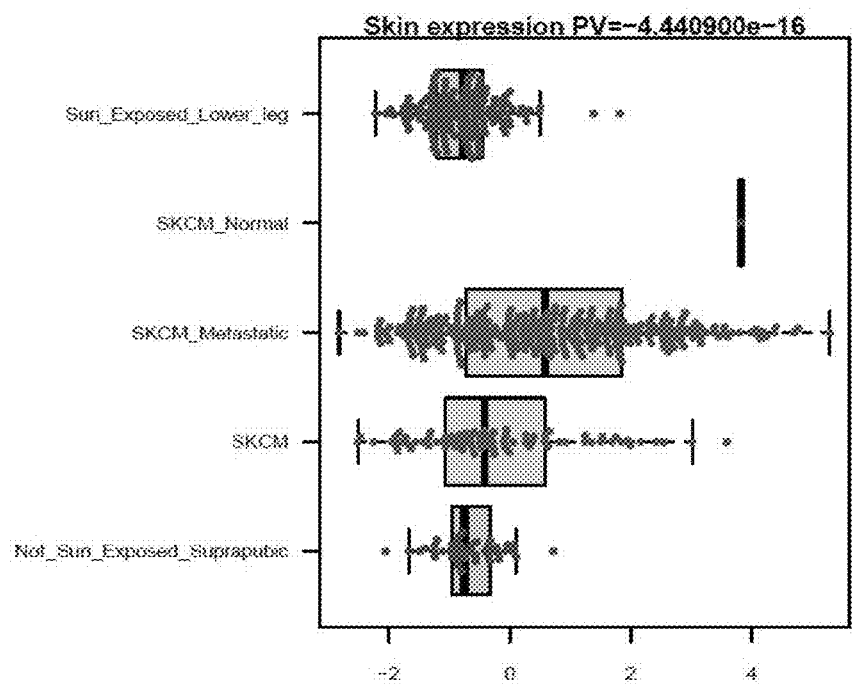
FIG. 9 presents PVRIG expression in normal skin vs. melanoma (GTEx and TCGA analysis). Such over-expression was observed in additional solid tumors and results from infiltrating lymphocytes and NK cells in the tumor microenvironment. In normal condictions, no infiltrating immune cells are present and therefore PVRIG expression levels are very low.
Figure 10:
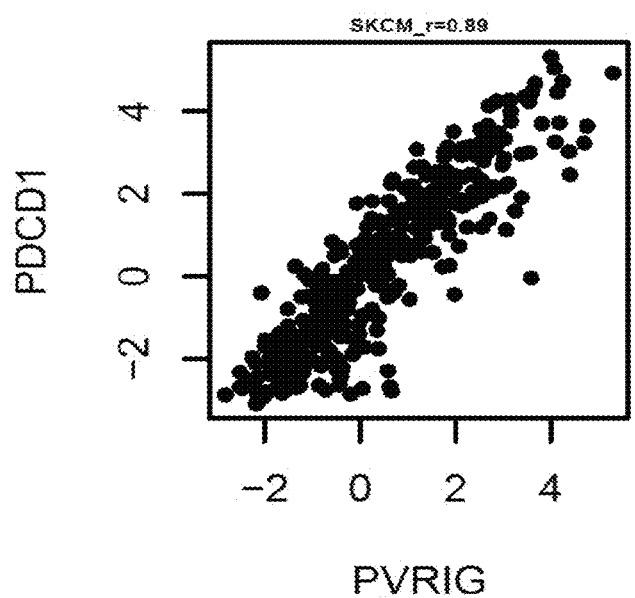
FIG. 10 presents the correlations of PVRIG and PD1 in melanoma from TCGA samples, with several T cell makers in lung adenocarcinoma, colon adenocarcinoma and melanoma. The marker CD3 is a general markers for T cells and is also expressed on NKT cells. CD4 and CD8 markers are used to characterized subpopulation of T cells.

The correlation analysis was conducted per tumor type and only correlations where both genes were expressed above 0 RPKM with at least 50 samples in the same tumor type, were considered. These gene expression signatures were tested for enrichment of interacting proteins, pathways and disease genes. Enrichment p-values were calculated for each tumor type and the mean −log(p-value) was used to rank the scoring gene sets. A clear signature of lymphocytes and T-cells was observed in a variety of cancers, as shown in FIG. 8. For instance, the top scoring gene in protein interaction was IL2, meaning that genes known to interact with IL2 are more correlated with PVRIG than expected by chance across most cancers. Further analysis showed that PVRIG expression in cancer tissues are higher than normal. While in FIGS. 5A-5C the median expression level of PVRIG is below 1 across most normal solid tissues, in FIG. 6 it is clearly higher than 1 in many cancers. As an example, when compared side by side in FIG. 7, melanoma PVRIG was expressed higher than normal skin (FIG. 9). We further characterized the source of over-expression in cancer. PVRIG is highly expressed in T cells and is highly correlated to markers of T cells in cancer. In FIG. 10, PVRIG correlation to CD3, CD4 and CD8 are shown as an example in three cancer types, namely, lung adenocarcinoma, colon adenocarcinoma and melanoma. In addition, PVRIG is highly correlated to PD1, a validated target for immunotherapy in cancer known to be expressed on T cells (FIG. 10).

Figure 13:
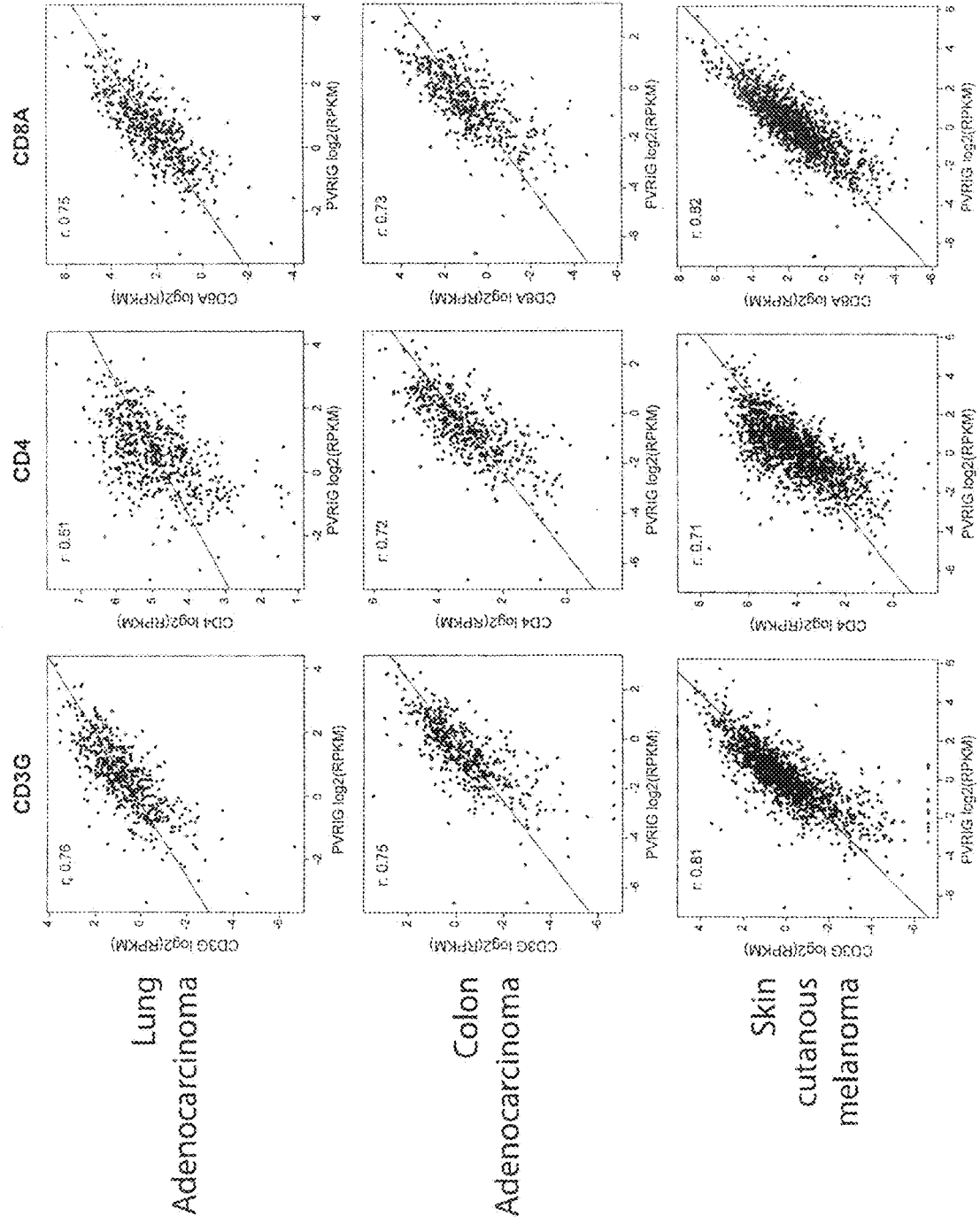
FIG. 13 Correlation of PVRIG with T cells and subpopulations of T cells. CD3G is component of the T cell receptor complex, CD4 is a maker for T helper cells and CD8A is component of CD8 protein used to identify cytotoxic T cells. PVRIG highly correlated with T cells in many types of tumors including lung adenocarcinoma, colon adenocarcinoma and melanoma which are shown here.

These gene expression signatures were tested for enrichment of interacting proteins, pathways and disease genes. A clear signature of lymphocytes and T-cells was observed in a variety of cancers, as shown in FIG. 8. We further analyzed the correlation of PVRIG to PD1 and showed high correlation between their expression in various tumors including breast lung pancreas and kidney (Table 2). Both PD-1 and PVRIG are highly expressed on activated T cells. PVRIG showed high correlation with T cell markers in cancer, namely, CD8A, CD4 and CD3G (FIG. 13). Taken together, these data demonstrate that cancer expression of PVRIG is associated with tumor infiltrating lymphocytes.

Methods: Genes correlation: FPKM values were transformed to log 2 (FPKM+0.1). Samples with value that fulfills log 2 (FPKM+0.1)<log 2(0.1) for at least one of the genes, were omitted. Pearson Correlation Coefficient (PCC) and the Least Squared Estimators for the regression line were computed for the 2 lists (one list per gene). PCCs with lower value than 0.5 were omitted as well as PCCs that failed to show significant value when testing the linear correlation between the expression levels of the 2 genes.

Gene Enrichment analysis: Pathway, interaction and disease data were obtained from GeneGo Metacore (https://portal.genego.com), Reactome (http://www.reactome.org) and KEGG Pathways (http://www.genome.jp/kegg). To identify pathways and processes that were enriched within a given gene list, a hyper-geometric-based enrichment analysis was implemented. The hyper-geometric p-value was calculated using the R program (http://www.R-project.org) with the following command: phyper(x-1, m, n-m, k and lower.tail=FALSE), where x is the number of genes from the gene list that are members of the pathway, m is the number of genes in the pathway, n is the total number of unique genes in all pathways, and k is the number of genes from the list that were present in at least one pathway. The resulting p-value is indicative of the likelihood of enriching for a specific pathway by chance given the size of the gene list. The same analytical procedure was applied to gene interactions where all genes interacting with a given gene were treated as a pathway; or genes associated with a disease where all associated genes were treated as a pathway. See FIGS. 64A64B.

Figure 22:
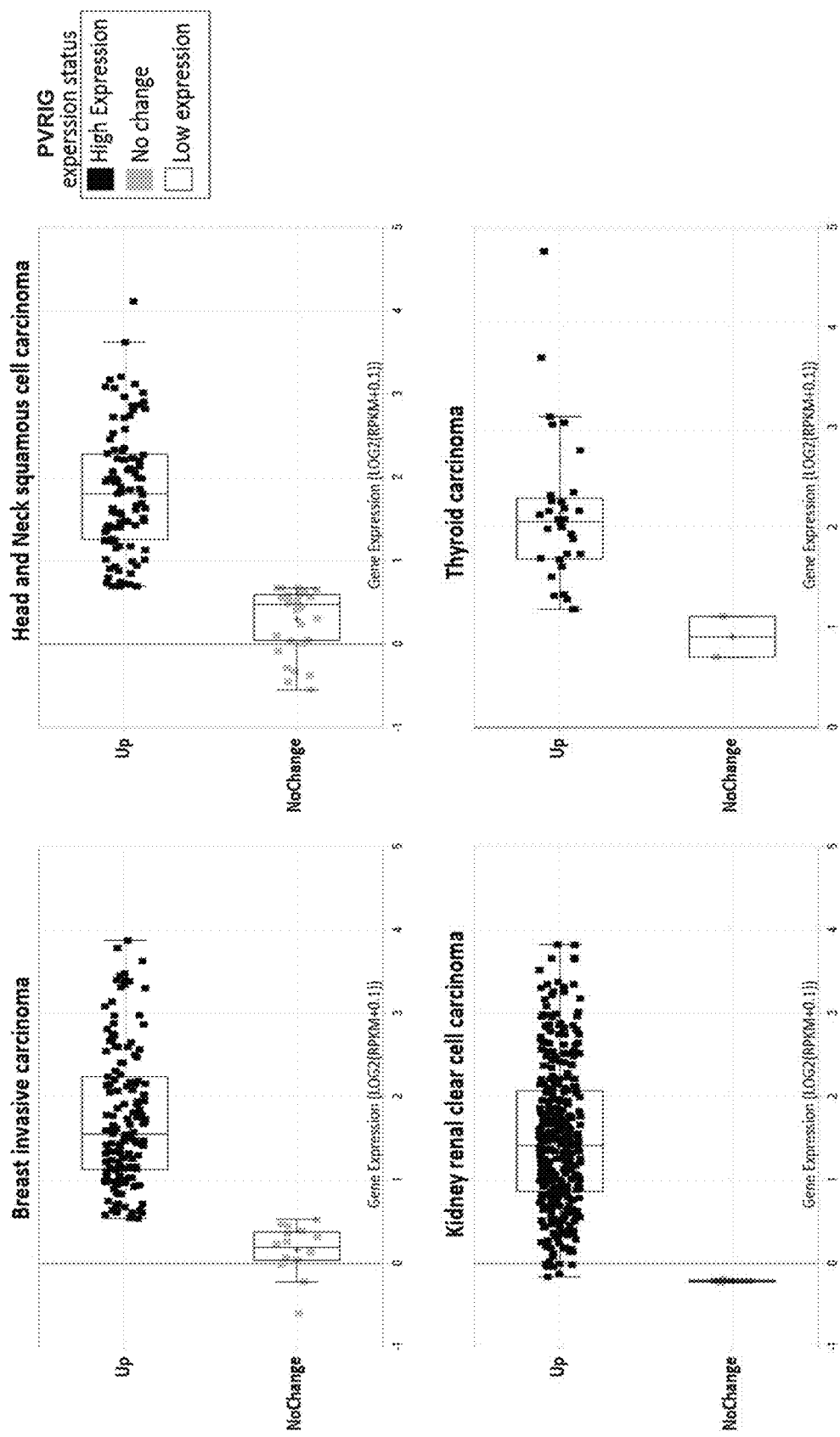
FIG. 22 shows PVRIG expression in 3 subgroups of low, no change and high levels of exhausted T cells. Exhausted T cells were selected based on high level expression of 4 markers: CD8A, PD-1, TIM-3 and TIGIT. Low expressing samples are not shown since none had any detectable levels of PVRIG.
Figure 23:
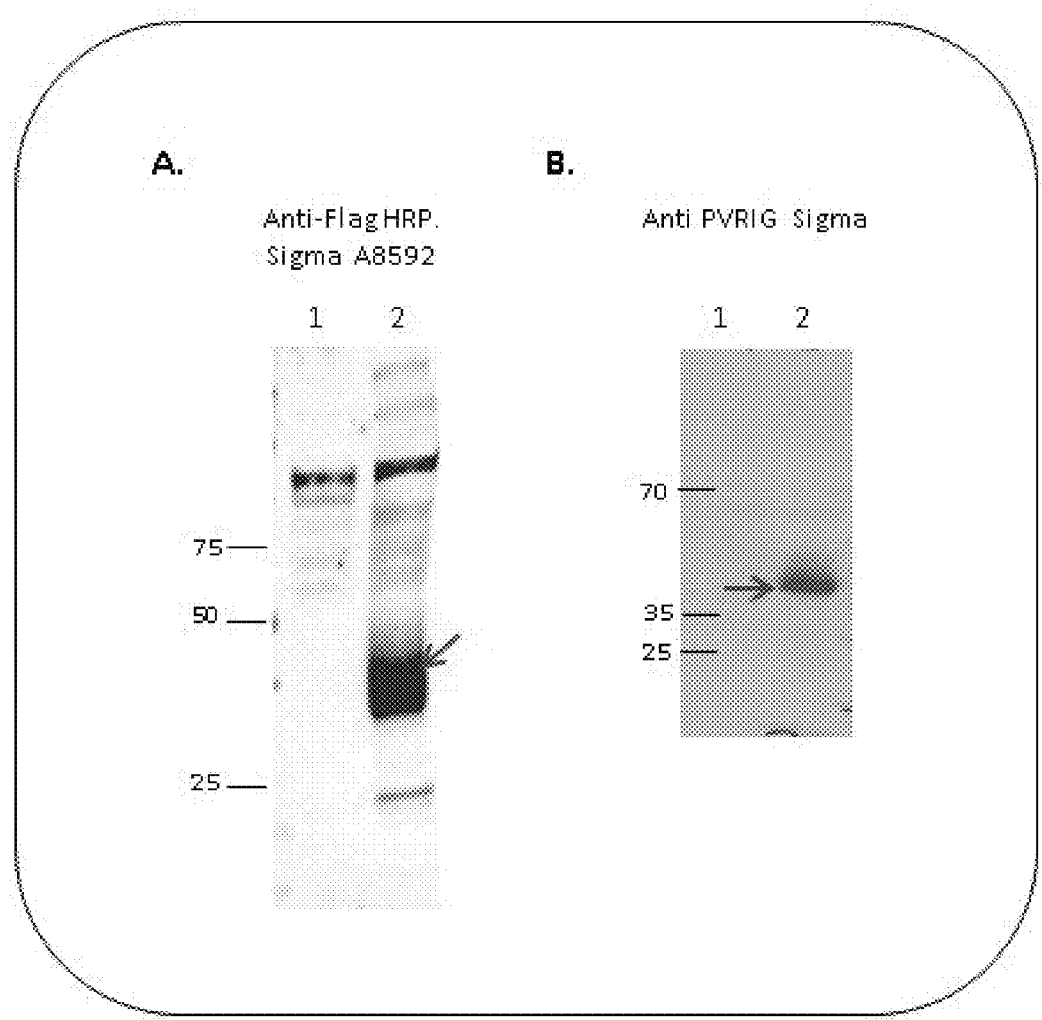
FIGS. 23A-23B: Western blot analysis of ectopically expressed human PVRIG protein. Whole cell extracts of HEK293 cell pools, previously transfected with expression construct encoding human PVRIG-flag (lane 2) or with empty vector (lane 1) were analyzed by WB using an anti-flag antibody (23A) or anti-PVRIG antibodies (23B).

PVRIG expression was associated with exhausted T cells in cancer. Cancer samples from TCGA were chosen that have high (4th quartile) expression of the following 4 markers: CD8, PD-1, TIM-3 and TIGIT. Cancer samples were then divided to high, no change and low levels of the combined expression of the 4 markers. PVRIG was not detected in any of the low expressing markers (low or no exhausted T cells). The vast majority of tumors associated with high levels of exhausted T cells expressed high levels of PVRIG (FIG. 22).

Example 1C

The expression of human and non-human primate PVRIG RNA and protein in cell lines and primary leukocytes was evaluated.

Protocols

FACS Analysis of Engineered Over-Expressing Cells:

The following cell lines were used to assess the specificity of anti-human PVRIG antibodies: HEK parental and HEK hPVRIG over-expressing cells. These cells were cultured in DMEM (Gibco)+10% fetal calf serum (Gibco)+glutamax (Gibco). For the HEK hPVRIG over-expressing cells, 0.5 μg/ml puromycin (Gibco) was also added to the media for positive selection. For FACS analysis, all cell lines were harvested in log phase growth and 50,000-100,000 cells per well were seeded in 96 well plates. Anti-human PVRIG antibodies (human IgG1, hIgG1) and their respective controls were added in single point dilutions (5 μg/ml), or as an 8 point titration series starting at 30 μg/ml on ice for 30 mins-1 hr. The titration series were conducted as either 1:3 or 1:3.3 fold serial dilutions. Data was acquired using a FACS Canto II (BD Biosciences) and analyzed using FlowJo (Treestar) and Prism (Graphpad) software.

FACS Analysis of Human Cell Lines:

The following cell lines were used to assess the expression and specificity of anti-human PVRIG antibodies: Jurkat, CA46, NK-92, OV-90, HepG2, and NCI-H441. Jurkat, CA46, and NCI-H441 cells were cultured in RPMI media+ 10% fetal calf serum, glutamax, non-essential amino acids (Gibco), sodium pyruvate (Gibco), and penicillin/streptomycin (Gibco). NK-92 cells were cultured in RPMI media+ 25% fetal calf serum, glutamax, non-essential amino acids, sodium pyruvate, penicillin/streptomycin, and 500 U/ml IL-2 (R&D systems). OV-90 cells were cultured in a 1:1 mixture of MCDB 105 media (Sigma) containing a final concentration of 1.5 g/L sodium bicarbonate (Life Technologies) and Media 199 (Sigma) containing a final concentration of 2.2 g/L sodium bicarbonate with a final concentration of 15% fetal calf serum. HepG2 cells were cultured in DMEM+10% fetal calf serum+glutamax. For FACS analysis, all cell lines were harvested in log phase growth and 50,000-100,000 cells per well were seeded in 96 well plates. Anti-human PVRIG antibodies (hIgG1) and their respective controls were added in single point dilutions (5 μg/ml), or as an 8 point titration series starting at 30 μg/ml on ice for 30 mins-1 hr. The titration series were conducted as either 1:3 or 1:3.3 fold serial dilutions. Data was acquired using a FACS Canto II and analyzed using FlowJo and Prism software.

FACS Analysis of Naïve Human Primary Leukocytes:

Primary leukocytes were obtained by Ficoll (GE Healthcare) gradient isolation of peripheral blood (Stanford Blood Bank). Leukocytes as isolated peripheral blood mononuclear cells (PBMC) were frozen down in liquid nitrogen at a density between 1×10⁷ and 5×10⁷ cells/ml in a 10% DMSO (Sigma), 90% fetal calf serum mixture. To assess protein expression of PVRIG on PBMC, antibody cocktails towards major immune subsets were designed that included human anti-PVRIG antibodies. Anti-human PVRIG antibodies (hIgG1) and their respective controls were added in single point dilutions (5 μg/ml), or in some cases, as an 8 point titration series starting at 10 or 30 μg/ml on ice for 30 mins-1 hr.

Briefly, antibody cocktail mixtures were added to resuscitated PBMC that were seeded at $5\times10^5$-$1\times10^6$ cells/well upon prior Fc receptor blockade and live/dead staining (Aqua Live/Dead, Life Technologies). Antibody cocktails were incubated with PBMC for 30 mins-1 hr on ice. PBMC were then washed and data was acquired by FACS using a FACS Canto II. Data was analysed using FlowJo and Prism software. Immune subsets that were analysed include CD56 dim NK cells, CD56 bright NK cells, CD4+ T cells, CD8+ T cells, non-conventional T cells (e.g. NKT cells and γδ T cells), B cells, and monocytes.

FACS Analysis of Activated Human Effector Lymphocytes:

In some cases, expression of PVRIG was assessed on activated effector lymphocyte subsets either isolated from whole PBMC or in whole PBMC preparations. Effector lymphocytes were stimulated with combinations of cytokines, combinations of antibodies and cytokines, or pathogenic products. FACS analysis of PVRIG expression on activated cells was performed analogous to that described above for naïve primary leukocytes.

To study PVRIG expression on stimulated NK cells, CD56+ cells were isolated and cultured in various cocktails of cytokines for 1-3 days in NK cell media (RPMI+10% fetal calf serum, glutamax, penicillin/streptomycin, non-essential amino acids, sodium pyruvate, and beta-mercaptoethanol [Gibco]). NK cells were sorted either using anti-human CD56+ microbeads (Miltenyi Biotec) or the human NK cell isolation kit (Miltenyi Biotec) according to the manufacturer's instructions. Cocktails of cytokines used to simulate NK cells included IL-2, IL-12, IL-15, IL-2/IL-12, IL-2/IL-15, IL-12/IL-15 (R&D systems).

To study PVRIG expression on stimulated T cells, CD4+ or CD8+ T cells were isolated using CD4+ or CD8+ microbeads (Miltenyi Biotec). The isolated cells were cultured for 3 days in the presence of various activating conditions in T cell media (RPMI+10% fetal calf serum, glutamax, penicillin/streptomycin, non-essential amino acids, sodium pyruvate). Conditions used to stimulate isolated T cells include human dynabead stimulation (beads coupled to CD3/CD28 antibodies, Life Technologies) with IL-2 or cytokine cocktails that drive T cells to certain phenotypes (e.g. Th1, Th2, Th17, and T regulatory phenotypes). Th1 driving cytokines are recombinant IL-12 (R&D systems) and an anti-IL-4 neutralizing antibody (Biolegend). Th2 driving conditions are recombinant IL-4 (R&D systems) and an anti-IFN-gamma neutralizing antibody (Biolegend). Th17 driving conditions are recombinant IL-6 (R&D systems), TGF-beta (R&D systems), IL-23 (R&D systems), and anti-IL-4 and anti-IFNγ neutralizing antibodies. T regulatory driving conditions are recombinant TGF-beta and IL-2, and anti-IL-4 and anti-IFNγ neutralizing antibodies.

Alternatively, activated T cells were also analyzed in whole stimulated PBMC cultures with *staphylococcal* enterotoxin B (SEB) antigen (List Biological Laboratories) for 3 days, or in a mixed lymphocyte reaction (MLR) where CD4+ T cells are co-cultured with allogeneic dendritic cells for 2 or 5 days.

FACS Analysis of Human Polarized Monocytes:

PVRIG expression was assessed on dendritic cells derived from polarized monocytes. In this instance, CD14+ cells were enriched using RosetteSep human monocyte enrichment according to manufacturer's instructions. After CD14+ cell enrichment, monocytes were polarized to dendritic cells upon culture with GM-CSF (R&D systems) and IL-4 (R&D systems) for 4 days in RPMI+10% fetal calf serum, glutamax, penicillin/streptomycin, non-essential amino acids, sodium pyruvate, and beta-mercaptoethanol.

RNA expression analysis of human cell lines and leukocytes by qPCR: Cell lines that were assessed for RNA expression by qPCR were Jurkat, CA46, Daudi, Raji, and expi 293 cells. Jurkat, CA46, Raji, and Daudi cells were cultured in RPMI media+10% fetal calf serum, glutamax, non-essential amino acids, sodium pyruvate, and penicillin/streptomycin. Expi 293 cells were cultured in DMEM+10% FCS+glutamax. OV-90, HepG2, and NCI-H441 RNA was analysed by a bioinformatics screen of the cancer cell line atlas. For those cell lines that were assessed for RNA expression by qPCR, the cells were harvested in log phase growth and 1,000,000 cells were harvested, washed in PBS, and lysed in 350 µl of RLT buffer (Qiagen). Lysed cells in RLT buffer were stored at −80° C. until use.

Primary leukocytes that were assessed for RNA expression were CD56+ NK cells, CD4+ T cells, CD8+ T cells, and CD14+ monocytes. Cell populations were isolated using human CD56+, CD4+, CD8+, and CD14+ positive selection kits according to manufacturer's instructions (Miltenyi Biotec). After sorting, cells were lysed in 350 µl of RLT buffer and stored at −80° C. until use. In some instances, activated PBMC subsets (activation conditions outlined above) were harvested from culture and were lysed in 350 µl of RLT buffer and stored at −80° C. until use.

Upon day of use, RNA was generated from lysed cells using the Qiagen mini kit according to the manufacturer's instructions. cDNA was generated using Applied Biosystems high capacity cDNA reverse transcription kit. qPCR using cDNA was performed using Taqman primers (ThermoFisher) and Applied Biosystems Taqman fast advanced mastermix. The PVRIG primer set used was Taqman catalogue number: Hs04189293_g1. Beta-actin housekeeping primer set used was Taqman catalogue number: Hs01060665_g1. Expression of transcript was assessed by quantifying Ct values and relative expression was calculated by the 2(−ΔΔCt) method. Data was acquired on an Applied Biosystems Step One Plus instrument.

FACS Analysis of Cynomolgus PVRIG Engineered Over-Expressing Cells:

The following cell lines were used to assess the cross-reactivity of anti-human PVRIG antibodies with cynomolgus PVRIG (cPVRIG): expi parental and expi cPVRIG over-expressing cells. These cells were cultured in DMEM+10% fetal calf serum+glutamax. expi cPVRIG transient over-expressing cells were generated by electroporating cPVRIG DNA into parental expi cells using the Neon transfection system. For FACS analysis, expi cPVRIG cells were used between 1-3 days post transfection. Parental expi cells were harvested from log growth phase. 50,000-100,000 cells of per well of each type were seeded in 96 well plates. Anti-human PVRIG antibodies (hIgG1) and their respective controls were added in single point dilutions (5 µg/ml), or as an 8 point titration series starting at 100 µg/ml on ice for 30 mins-1 hr. The titration series were conducted as either 1:3 or 1:3.3 fold serial dilutions. Data was acquired using a FACS Canto II and analyzed using FlowJo and Prism software.

FACS Analysis of Naïve Primary Cynomolgus Monkey Leukocytes:

Primary cynomolgus monkey (cyno) leukocytes were obtained from fresh blood which was drawn no longer than 24 hours prior to expression analysis. Blood was sourced from Bioreclamation. To assess protein expression of PVRIG on cyno PBMC, antibody cocktails towards major immune subsets were designed that included human anti-PVRIG antibodies. Anti-human PVRIG antibodies (hIgG1) and their respective controls were added in single point dilutions (5 µg/ml).

Briefly, antibody cocktail mixtures were added to PBMC that were seeded at $5 \times 10^5$-$1 \times 10^6$ cells/well upon prior Fc receptor blockade and live/dead staining. Antibody cocktails were incubated with PBMC for 30 mins-1 hr on ice. PBMC were then washed and data was acquired by FACS using a FACS Canto II. Data was analysed using Prism software. Immune subsets that were analysed include CD16+ lymphocytes, CD14+/CD56+ monocytes/myeloid cells, and CD3+ T cells.

RNA Expression Analysis of Primary Cynomolgus Monkey Leukocytes:

Primary leukocytes that were assessed for RNA expression were CD56+, CD16+, and CD56−/CD16− subsets. Cell populations were isolated using non-human primate CD56 and CD16 positive selection kits according to manufacturer's instructions (Miltenyi Biotec). After sorting, cells were lysed in 350 ul of RLT buffer and stored at −80° C. until use.

Upon day of use, RNA was generated from lysed cells using the Qiagen mini kit according to the manufacturer's instructions. cDNA was generated using Applied Biosystems high capacity cDNA reverse transcription kit. qPCR using cDNA was performed using Taqman primers and Applied Biosystems Taqman fast advanced mastermix. Two sets of primers to detect cyno PVRIG were designed by Compugen USA, Inc and manufactured by Genscript. The sequence and primer codes are:

```
Primer set 1
Forward:
                                         (SEQ ID NO: 2)
CTTGTGTTCACCACCTCTGG Reverse:
```

```
                                                (SEQ ID NO: 3)
TGTTCTCATCGCAGGAGGTC

Primer set 2
Forward:
                                                (SEQ ID NO: 4)
TTGGCTGTGGATACCTCCTT Reverse:
                                                (SEQ ID NO: 5)
ATAAGGGTCGTGGAGAGCAG
```

Beta-actin primers were used for housekeeping and the primer set used was Taqman catalogue number: Mf04354341_g1. Expression of transcripts was assessed by quantifying Ct values and relative expression was calculated by the $2^{(-\Delta\Delta Ct)}$ method. Products generated with PVRIG primers and beta-actin primers were also size analysed by traditional RT-PCR using a 2.5% agarose gel. qPCR data was acquired using an Applied Biosystems Step One Plus instrument.

Results

Figure 27:
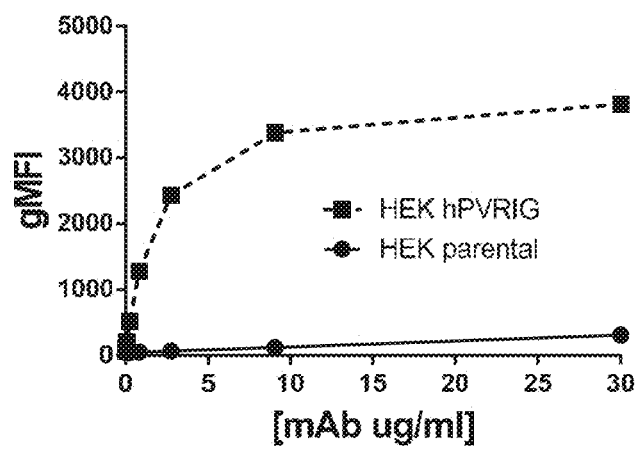
FIG. 27 PVRIG antibody specificity towards HEK cells engineered to overexpress PVRIG. Data shows absolute geometric MFI (gMFI) measurements as a function of increasing antibody concentration. The broken black line with squares shows staining of HEK hPVRIG cells with a representative anti-human PVRIG antibody (CPA.7.021), and the solid black line with circles shows staining of HEK parental cells with the same antibody.

PVRIG Antibodies Recognize PVRIG on Overexpressing Cells:

To screen for antibodies that were specific for PVRIG, we assessed the ability of antibodies that were generated from a phage campaign to bind HEK cell lines that were engineered to overexpress PVRIG. The majority of antibodies from this campaign upon reformatting to human IgG1 bound to the HEK hPVRIG cells, albeit with varying affinity. Furthermore, the majority of these antibodies also showed low background binding to HEK parental cell lines indicating high specificity towards PVRIG. FIG. 27 shows one example of the specificity of PVRIG antibodies. A summary of all binding characteristics of the antibodies towards HEK hPVRIG cells relative to control that were generated in this phage campaign are displayed in FIGS. 31A-31B.

Human PVRIG RNA is Expressed in a Range of Cancer Cell Lines:

To initially screen for cell lines that could be used to assess PVRIG protein expression by antibodies, we examined the cancer cell line atlas for cell lines that were high for PVRIG RNA as assessed by bioinformatics. We found four cell lines that were readily accessible commercially that were high expressors for PVRIG RNA that we chose to validate by qPCR analysis. These cell lines were Jurkat, CA46, Raji, and Daudi.

Figure 28:
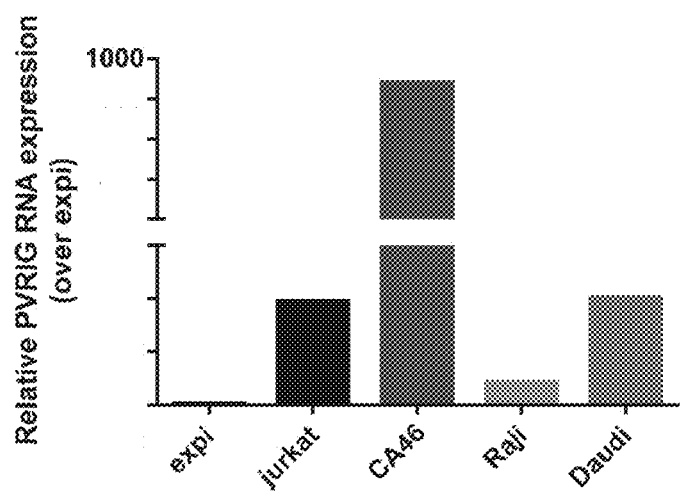
FIG. 28 PVRIG RNA was assessed in various cancer cell lines by qPCR. Data shown is relative expression of PVRIG RNA in cell lines as fold change over levels in expi cells as assessed by the $2^{(-\Delta\Delta Ct)}$ method.

When qPCR analysis was conducted, we detected PVRIG RNA in all four cell lines consistent with the bioinformatics analysis (FIG. 28). As a negative control we included expi cells that had relatively low PVRIG RNA expression.

Figure 29:
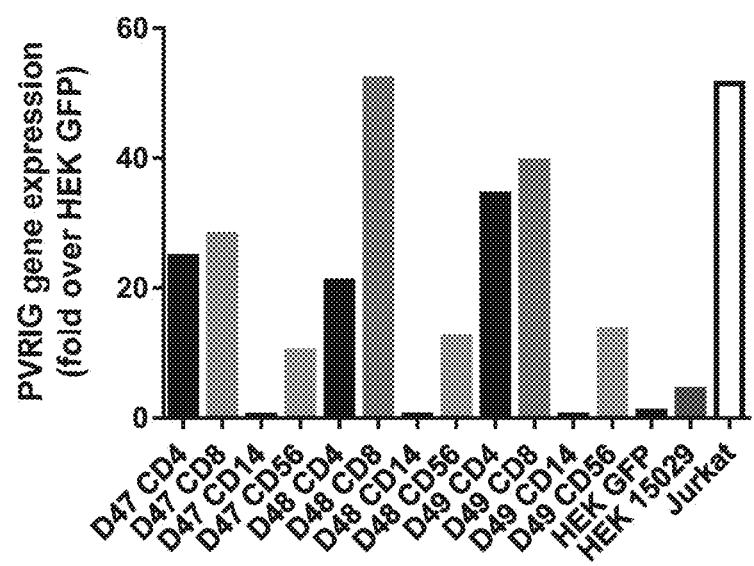
FIG. 29 PVRIG RNA was assessed in sorted PBMC subsets by qPCR. Data shown is relative expression of PVRIG RNA in each subset as fold change over levels in HEK GFP cells as assessed by the $2^{(-\Delta\Delta Ct)}$ method. D47-D49 denote three individual donors. CD4 denotes CD4 T cells, CD8 denotes CD8 T cells, CD14 denotes monocytes, and CD56 denotes NK cells.

Human PVRIG RNA is Expressed in T Cells and NK Cells:

To initially screen PBMC for subsets likely to be positive for PVRIG protein as detected by our antibodies, we sorted major PBMC subsets and examined PVRIG RNA expression by qPCR. Levels of PVRIG RNA in CD56+ NK cells, CD4+ T cells, CD8+ T cells, and CD14+ monocytes were compared to those in Jurkat, HEK parental, and HEK hPVRIG cell lines. As shown in FIG. 29, PVRIG RNA was detected most highly and up to 50 fold higher in CD4+ T cells, CD8+ T cells, and CD56+ NK cells when normalized to HEK GFP cells. Similar to FIG. 28, Jurkat cells also showed positive expression. In contrast, CD14+ monocytes did not show higher PVRIG expression relative to HEK GFP cells indicating very low PVRIG RNA expression.

Figure 30A:
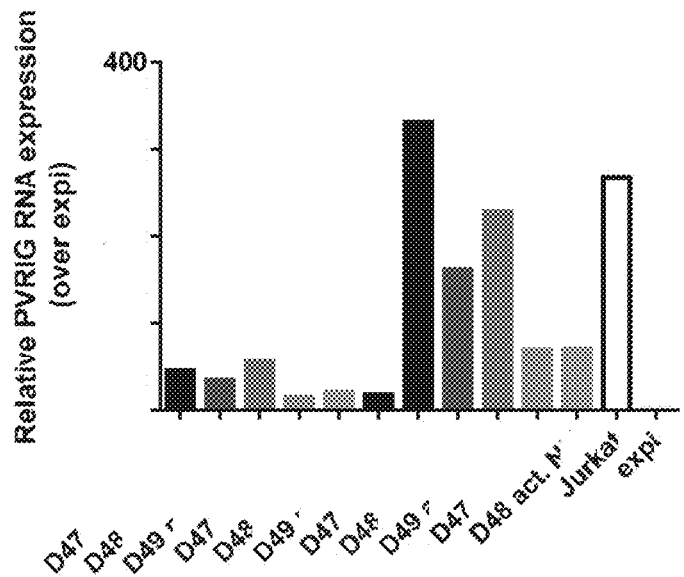
FIGS. 30A-30B.
Figure 30B:
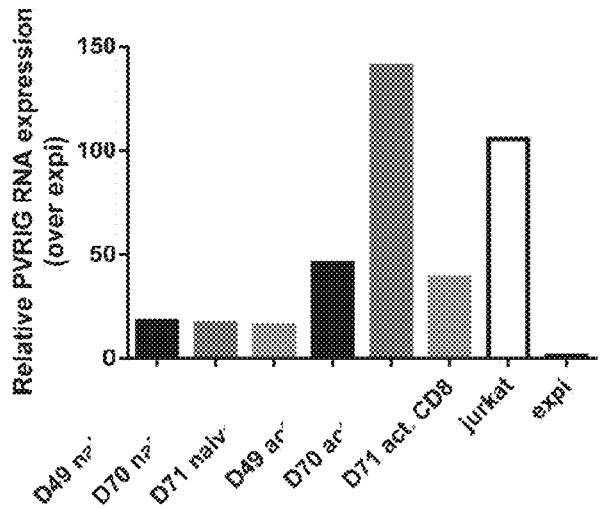

In addition to analyzing naïve PBMC, select populations (effector lymphocytes) were also activated under various stimulatory conditions and expression of PVRIG RNA was assessed. More specifically, NK cells were activated with various combinations of stimulatory cytokines, whereas T cells were polyclonally activated with human activator dynabeads or staphylococcus enterotoxin B (SEB) with or without polarizing cytokines (see protocol section for details). As shown in FIGS. 30A and 30B, PVRIG RNA expression generally increased in both NK cells and T cells upon various stimulation conditions, the extent of which depended on the individual donor. More specifically, FIG. 30a shows PVRIG RNA expression in naïve and activated CD4 T cells and NK cells. FIG. 30b shows PVRIG RNA expression in naïve and activated CD8 T cells.

PVRIG Antibodies Recognize PVRIG Protein on NK Cells Most Prominently in Naïve and Activated Primary Immune Subsets:

Upon confirming the RNA expression pattern of PVRIG RNA expression in naïve and activated PBMC subsets, we used our panel of PVRIG antibodies to assess protein expression. We first assessed PVRIG expression in naïve PBMC subsets. The population which displayed the highest level of PVRIG was NK cells. CD4+ and CD8+ T cells showed low levels of PVRIG, while B cells and monocytes had no detectable expression. A summary of expression on NK cells and CD8+ T cells as detected by our antibodies is shown in FIGS. 32A-32B. Other minor subsets also displayed PVRIG expression and included non-conventional T cells such as NKT cells and γδ T cells. The expression pattern on PBMC subsets was very similar across all donors we sourced and analyzed.

When PVRIG protein was assessed after various stimulation conditions (including polyclonal simulation, cytokine stimulation, and MLR), there was no robust up-regulation of PVRIG on any PBMC subsets, including NK cells and CD4+ and CD8+ T cells. Furthermore, monocytes which were polarized in vitro to dendritic cells with GM-CSF and IL-4 did not show detectable PVRIG expression consistent with that seen on non-polarized monocytes.

Figure 33:
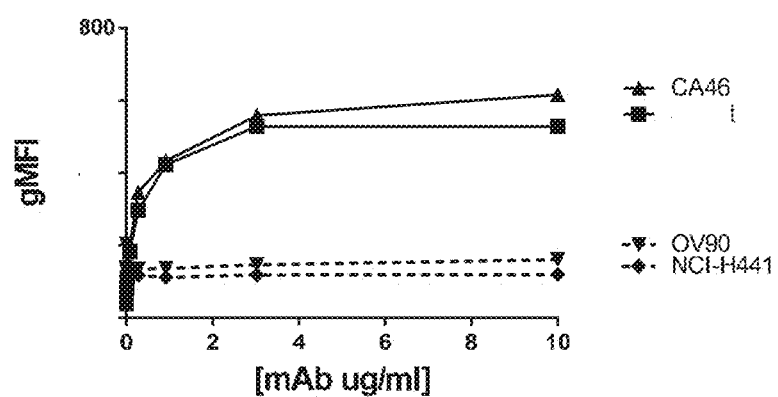
FIG. 33 PVRIG antibody specificity towards CA46 and Jurkat cells. Data shows absolute geometric MFI (gMFI) measurements by FACS as a function of increasing antibody concentration. The solid black line with triangles shows staining of CA46 cells with anti-human PVRIG antibody (CPA.7.021) and the solid black line with squares shows staining of Jurkat cells. OV-90 (broken line with upside down triangles) and NCI-H4411 (broken line with diamonds) are shown as negative controls.
Figures 34A, 34B:
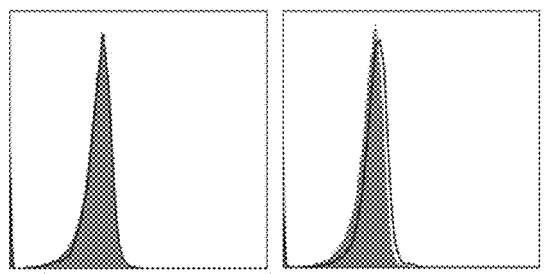
FIGS. 34A-34D PVRIG antibody cross-reactivity towards cPVRIG transient cells. Data shows an example of an antibody that is a negative binder (a-b, CPA.7.021) and a positive binder (c-d, CPA.7.024) on cPVRIG transient cells. Solid grey histograms indicate control antibody, open black histograms indicate the antibody of interest. Cells were stained with each antibody at a concentration of 5 µg/ml.
Figures 34C, 34D:
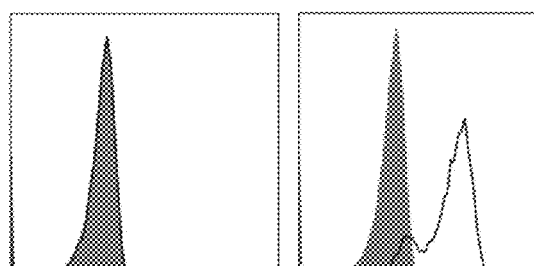

PVRIG is Detected on Cell Lines by a Proportion of PVRIG Antibodies:

In addition to screening PBMC for PVRIG protein expression, we wanted to understand whether it was also expressed on cancer cell lines. Using the positive cell lines identified by RNA expression (FIG. 28), we chose to screen our antibodies on Jurkat and CA46 cells as they showed the lowest absolute Ct values relative to our housekeeping gene. We also chose a range of negative cell lines to further validate the specificity of our antibodies which included OV-90, NCI-H441, and HepG2. A proportion of our antibodies did detect PVRIG protein expression on Jurkat and CA46 cells (FIGS. 31A-31B), but not the negative cell lines. An example of PVRIG detection on Jurkat and CA46 is shown in FIG. 33 with a representative antibody, CPA.7.021. The expression on Jurkat and CA46 was completely in accordance with each other and the intensity of expression was similar across the two cell lines.

PVRIG Antibodies Detect Cynomolgus PVRIG Transiently Expressed on Expi Cells:

In order to assess the pre-clinical suitability of our anti-human PVRIG antibodies for pharmacological studies in cynomolgus monkey, we wanted to understand whether our antibodies were able to cross-react with cynomolgus PVRIG (cPVRIG). A proportion of our antibodies were able to detect cPVRIG which was transiently transfected onto expi cells (FIG. 29). An example of an antibody that yielded negative staining (CPA.7.021) and one that yielded positive staining (CPA.7.024) are shown in FIGS. 34A-34D.

Figure 35:
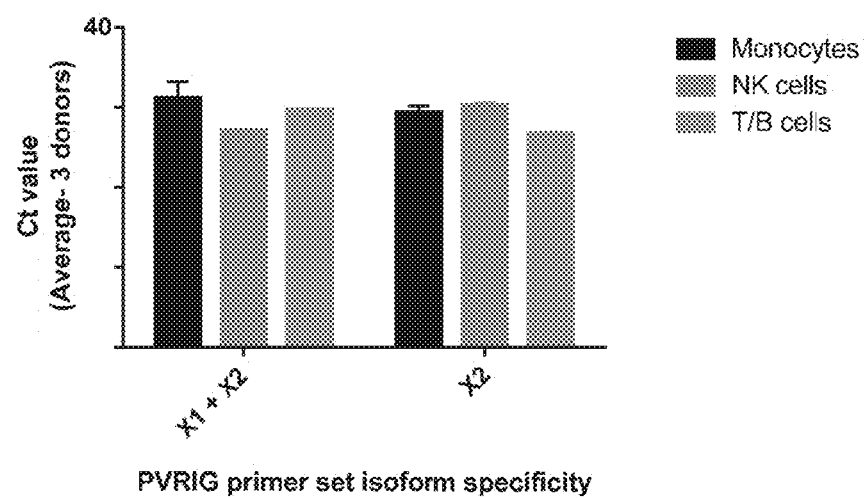
FIG. 35 cPVRIG RNA was assessed in sorted cyno PBMC subsets by qPCR. Data shown is the average Ct values from three cyno donors as detected by two primer sets directed at two distinct areas of the cPVRIG gene.

PVRIG RNA is Detected in Cynomolgus PBMC:

Prior to assessment of PVRIG protein on cyno PBMC, we firstly wanted to determine the PVRIG RNA expression profile in cyno PBMC subsets. As no cPVRIG primers set existed, we designed two sets that were directed at two distinct sites on the cPVRIG gene. One primer set was specific for the X2 variant of cPVRIG, while the other set was able to pick up both the X1 and X2 variant. As shown in FIG. 35, both primer sets were able to detect cPVRIG RNA at a similar level when compared to each other. Furthermore, unlike human PBMC where there was a distinct PVRIG RNA signature in effector lymphocytes (NK and T cells) compared to monocytes, cPVRIG RNA was expressed at a similar level across all PBMC subsets from all donors assessed.

Figure 36A:
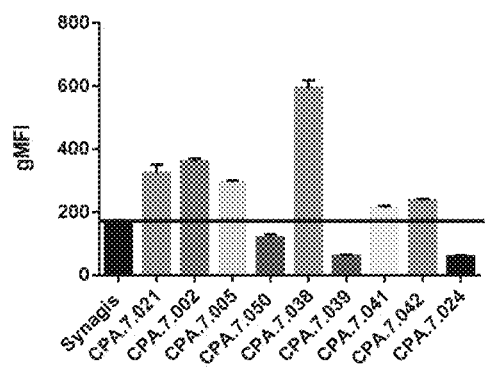
FIGS. 36A-36C cPVRIG protein was assessed on a) CD16+ lymphocytes (NK cells), b) CD14+ CD56+ myeloid cells (monocytes), and c) CD3+ lymphocytes (T cells) by FACS. Data is shown as absolute geometric MFI, with the solid black line indicating background fluorescence levels. Data is representative of a sample of our panel of anti-human PVRIG antibodies tested in three cyno donors.
Figure 36B:
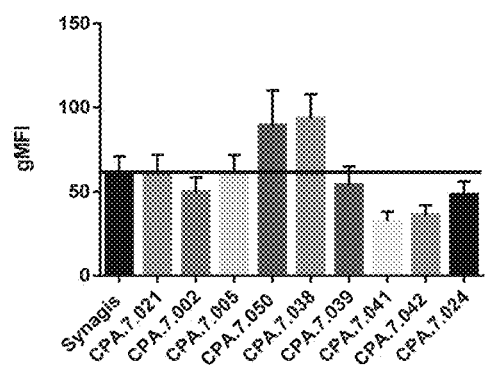
Figure 36C:
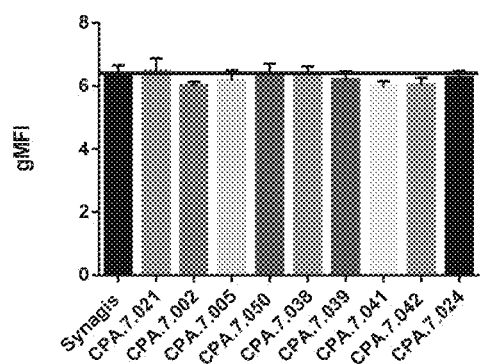

PVRIG Protein Expression on Cynomolgus PBMC is Very Low or Negative:

Having established a cPVRIG RNA profile for cyno PBMC, we screened for the presence of cPVRIG protein on cyno PBMC using a select panel of anti-human PVRIG antibodies. The antibodies chosen to screen PBMC were based on their ability to bind cPVRIG transient cells and/or functional activity. As shown in FIGS. 36A-36C, we were able to detect low level of expression of cPVRIG on the CD16+ lymphocyte subset (NK cells) from a range of antibodies, but not the CD3+ lymphocyte subset (T cells) nor the CD14+ CD56+ myeloid subset (monocytes). Despite this data, those antibodies that showed positive detection over control (as denoted by the solid black line) did not correlate to those that were able to bind the cPVRIG transient cells. For example, the level of staining by CPA.7.021 was more than CPA.7.024 despite the former not binding to cPVRIG transient cells (see FIGS. 36A-36C).

Summary and Conclusions:

Using an antibody phage platform, we have been able to successfully generate monoclonal antibodies towards the human PVRIG antigen. Using engineered over-expressing cells as well as a suite of cancer cell lines, we showed that our antibodies are highly specific to the PVRIG antigen, and are able to detect protein expression which correlated with RNA expression. Upon analysis of human PBMC subsets, we showed that the PVRIG protein is most highly expressed on NK cells, with low expression on conventional CD3+ T cells, and not detectable on B cells and myeloid cells. The expression did not robustly change upon exposing these cell types to various stimulation conditions. We also showed that a panel of our antibodies are cross-reactive with the cynomolgus monkey (cyno) PVRIG antigen through assessing their binding to over-expressing cells. However, the combination of the low level of binding of this panel of antibodies to cyno PBMC, the lack of protein correlation with RNA, and the discordance of their ability to bind to over-expressing cells (compared to PBMC) indicates that the PVRIG antigen on cyno PBMC may be very low/negative, or it is expressed in a different/more complex form compared to the over-expressing cells.

Example 1D

Expression of PVRIG in PBMC Subsets from Healthy Donors:

The expression of PVRIG in PBMC subsets from healthy donors was tested (gating strategy is shown in FIG. 1a). In the tested samples, PVRIG was shown to express on CD8+ T cells (data not shown), CD8α+ γδ T cell (data not shown), double-negative γδ T cells (data not shown) and to a milder extent also on CD4+ T cells (data not shown) of healthy donors PBMCs (n=5).

Example 1E

Co-Expression of PVRIG with PD1, TIGIT and HLA-DR in Ovarian Cancer Ascites, PBLs of MSS, CRC, and in Resting and Allo-Activated Healthy PBMCs:

PVRIG is co-expressed with TIGIT on CD8+ T cells in ovarian cancer ascites (data not shown). In this sample, a mixed level of PVRIG expression was observed, that overlapped with that of PD-1 expression. Low level of HLA-DR correlated with low level of PVRIG expression. Very low level of PVRIG was observed on CD4+ T cells is in this specific sample, indicating no correlation with PD1, TIGIT and HLA-DR.

In PBLs of MSS CRC patients, PVRIG is co-expressed with TIGIT on CD8+ T cells (data not shown). Low expression levels of PVRIG were observed in this sample which was in correlation with the low levels of TIGIT and HLA-DR. TILs from this patient had small CD8+ population that stained positive for surface PVRIG, which was also positive for PD1 and TIGIT (data not shown). Intracellular stain reveled prominent PVRIG stain that mirrored the expression pattern of PD-1, showing two distinct populations that are PD1−PVRIG− and PD1+PVRIG+ (data not shown). Intracellular PVRIG+ CD8+ T cells seem to better correlate with the HLA-DR+ and TIGIT+. PVRIG was not detectable on the surface of CD4+ T cells and only minority of the CD4+ cells showed positive intracellular PVRIG stain in the PD1+ population. Due to the very small intracellular PVRIG+ population, it is difficult to determine if PVRIG is co-expressed with TIGIT and HLA-DR.

In healthy PBMCs, PVRIG stain on CD8 T cells mirrored the expression pattern of PD-1 and TIGIT, showing distinct PD1−PVRIG− and PD1+PVRIG+ populations and distinct TIGIT−PVRIG− and TIGIT+PVRIG+ populations (data not shown). PVRIG was not detected on CD4+ cells. Interestingly, following allo-activation, co-expression of PVRIG and PD-1 was observed on CD4+ (but no on CD8+) (data not shown).

In summary, PVRIG was shown to co-express with TIGIT in CD8+ T cells from ovarian cancer ascites, MSS CRC patient's PBLs and with PD-1 healthy donor's PBMCs and with PD1 in CD4+ T cells of allo activated PBMCs from healthy donor.

Example 1F

Expression of PVRIG on Lymphocyte Populations from Healthy PBMCs Urachal Cancer, Colorectal Cancer, Ovarian Cancer Ascites and Lung Cancer:

Results: The expression of PVRIG on CD4+ and CD8+ T cells, NK cells and on CD4+ and CD8+ NKT cells was analyzed in healthy donors' PBMCs and tonsils and in TILs from urachal cancer, colorectal cancer, ovarian cancer ascites, lung cancer and melanoma.

In healthy donors' PBMCs (n=5) and in ovarian cancer ascites TILs (n=1) high levels of PVRIG expression was detected on NK cells (data not shown) and CD8+NKT cells (data not shown) and to a lower extent also on CD8+ T cells (data not shown) and CD4+ NKT (data not shown). CD4+ T cells also stained positively for PVRIG in some of the PBMCs, however the level of expression was quite low (data not shown).

In addition, PVRIG expression was detected on CD4+ T cells from two out of 6 colorectal cancer TILs tested, and in lung cancer TILs (n=3) (data not shown) and on NK cells from urachal cancer TILs (n=1).

No PVRIG expression was detected in melanoma TILs due to absence of TILs in the tested sample.

Example 1G

Additional evaluations were done to identify addition tissues that over express PVRIG in human and mouse cell lines.

Reagents: Human PVRIG TaqMan probes (Life technologies) Hs04189293_g1, Cat. #4331182, TaqMan probe for Housekeeping gene (HSKG) (Life technologies) human RPL19 Mm 01577060_gH, human HPRT1 Hs02800695_m1, human SDHA Hs00417200_m1, human PBGD Hs00609296_g1, and human TATA Box Hs00375874_g1. Mouse PVRIG TaqMan probes (Life technologies) CC70L8H, CC6RN19 Custom TaqMan probes. TaqMan probes for Housekeeping gene (HSKG) (Life technologies) mouse RPL19: Mm02601633_g1. ABI TaqMan Fast Advanced Master mix, part no. 4444557, Applied Biosystem. Commercial Human and Mouse cancer cell lines from American Type Culture Collection (ATCC) and CLS (Cell line service) are detailed in Table 1. RNA extraction from human and mouse cell lines was performed with RNAeasy Mini Kit (Qiagen cat #74014). cDNA was produced using High Capacity cDNA Reverse Transcription Kit (Applied Biosystems cat#4368814. Commercial mouse polyclonal Anti-PVRIG Ab MaxPab (B01), Abnova, Cat#H00079037-B01, diluted 1:200. Mouse IgG1, Life Technologies, Cat#MG100, diluted 1:200. Commercial mouse polyclonal Anti-PVRIG Ab, Sigma, Cat#SAB1407935, 10 µg/ml. Chrom pure Mouse IgG, whole molecule, Jackson, Cat#015-000-003, 10 µg/ml. Goat Anti Mouse-PE, Jackson, Cat#115-116-146, diluted 1:100. Custom polyclonal Rat-Anti mouse PVRIG, Batch#20153456C.1, Aldevron, 10 µg/ml. Custom Rat total IgG, Batch#GV20884.1, Aldevron, 10 µg/ml. Goat Anti Rat-PE, Jackson, cat#112-116-143, diluted 1:100. Anti-human PVRIG-CPA.7.024 mIgG1 conjugated to AF647, 10 µg/ml. Anti-human PVRIG-CPA.7.050 mIgG1 conjugated to AF647, 10 µg/ml. Anti-human PVRIG-CPA.7.005 mIgG1 conjugated to AF647, 10 µg/ml. Anti-human PVRIG-CPA.7.002 mIgG1 conjugated to AF647, 10 µg/ml. Synagis IgG1 conjugated to A647, 10 µg/ml. Anti-human PVRIG-CPA.7.021 mIgG1 conjugated to AF647, 10 µg/ml. Synagis IgG2 conjugated to A647, 10 µg/ml. Rabbit polyclonal anti PVRIG Ab, Sigma, Cat#HPA047497, diluted 1:300. Goat Anti Rabbit-HRP, Jackson, Cat#111-035-003, diluted 1:100. VioBlue, Fixable viability stain 450, BD Bioscience, cat #562247, diluted 1:1000. Human Trustain FcX, Biolegend, Cat#422302. Rat anti mouse CD16/CD32 Fc block, BD, Cat#553142. Ingenio Electroporation solution, Mirus, Cat#MIR50114. ON-TARGET plus Human PVRIG siRNA-SMARTpool, Dharmacon, Cat#L-032703-02. ON TARGET plus non targeting siRNA, Dharmacon, Cat#D-001810-01-05. The human cell lines used in the study are shown in FIG. 54.

Transcript Expression.

Quantitative RT-PCR (qRT-PCR): RNA (1-5 ug) extraction of human and mouse cell lines (detailed above in Tables 1 and 2) was preformed according to manufactures protocols. cDNA was prepared according to manufactures protocols (1 ug RNA diluted in 20 ul cDNA mix reaction). cDNA, prepared as described above, diluted 1:10 (representing 25 ng RNA per reaction), was used as a template for qRT-PCR reactions, using a gene specific TaqMan probes (detailed in materials & methods 1.1 1-4) Detection was performed using QuantStudio 12k device. The cycle in which the reactions achieved a threshold level of fluorescence (Ct=Threshold Cycle) was registered and was used to calculate the relative transcript quantity in the RT reactions. The absolute quantity was calculated by using the equation $Q=2^\wedge-Ct$. The resulting relative quantities were normalized to a relative quantities of housekeeping gene, mRPL19 or hRPL19.

Protein Expression Detection by Western Blot (WB):

The expression of human PVRIG in human cell lines was analyzed by WB using whole cell extracts (45 ug for the cancer cell lines, and 30 ug for the over expressing cell line and negative control cell line). Commercial rabbit polyclonal anti-human PVRIG pAb, Sigma, cat #HPA047497, diluted 1:300 in 5% BSA/TBST followed by secondary Ab goat anti-Rabbit-Peroxidase conjugated (Jackson, cat #111-035-003), diluted 1:20,000 in 5% milk TBST.

Protein Expression Analysis by Flow Cytometry (FACS):

The cell surface expression of PVRIG protein was analyzed by FACS. Human or mouse cell lines were stained with VioBlue reagent diluted 1:1000 in PBS. Cells were incubated 15 min at R.T. and then washed once with PBS. Cell lines for endogenous protein analysis were pre-incubated with the Fc receptor blocking solutions listed above in material section (2.5 µl/reaction of human blocker and 1 µl/reaction of mouse blocker was used according to the manufactures procedures). To detect the human PVRIG protein, cells were stained with a commercial polyclonal anti human PVRIG or by a custom monoclonal anti-human PVRIG mAbs (Inc production, detailed in materials & methods section above) diluted to a concentration of 10 µg/ml or 1:200 (for Sigma Ab and for mAb or for Abnova Ab respectively) or IgG1 Isotype control at the same concentration followed by Goat anti mouse PE conjugated Ab.

To detect the mouse PVRIG protein, cells were stained with a Custom rat polyclonal anti-mouse PVRIG pAb (Aldevron,) diluted to a concentration of 10 µg/ml or rat IgG whole molecule as isotypes control at the same concentration followed by Donkey anti Rat-PE conjugated Ab diluted 1:100.

PVRIG Knock Down:

Knock down of endogenous human PVRIG was carried out by transient transfection of siRNA. Transfection of 100 pmol PVRIG siRNA pool or scrambled siRNA performed by electroporation using Amaxa nucleofector device and MIRUS Ingenio electroporation solution, as listed above in materials & methods and according to the manufacture procedure. 48 hours post transfection, cells were collected for further analysis by qRT-PCR and FACS.

Figure 56A:
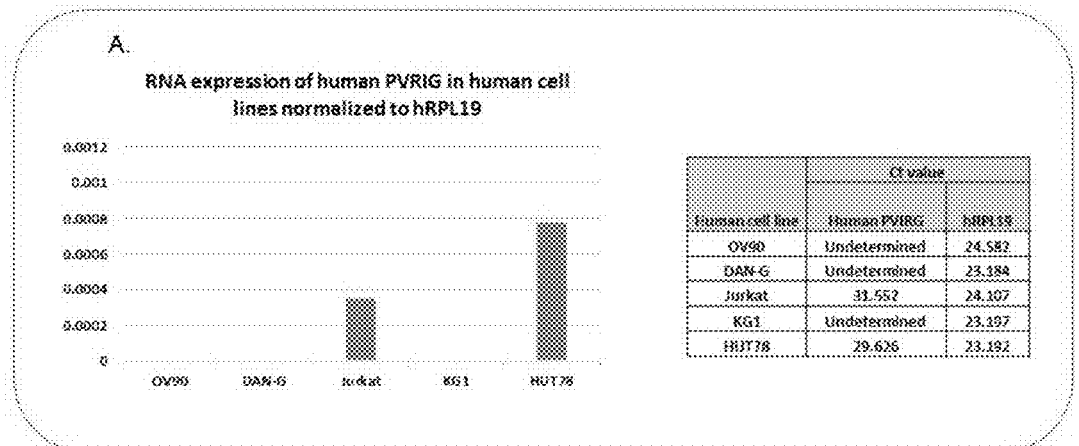
FIGS. 56A-56C. Transcript expression of human PVRIG in various Human cancer cell lines. Verification of the human transcript in several cell lines was performed by qRT-PCR using TaqMan probe. Column diagram represents data observed using TaqMan probe Hs04189293_g1. Ct values are detailed in the table. Analysis indicating high transcript in Jurkat, HUT78 and HL60, and lower levels in THP1 and RPMI8226 cell lines.
Figure 56B:
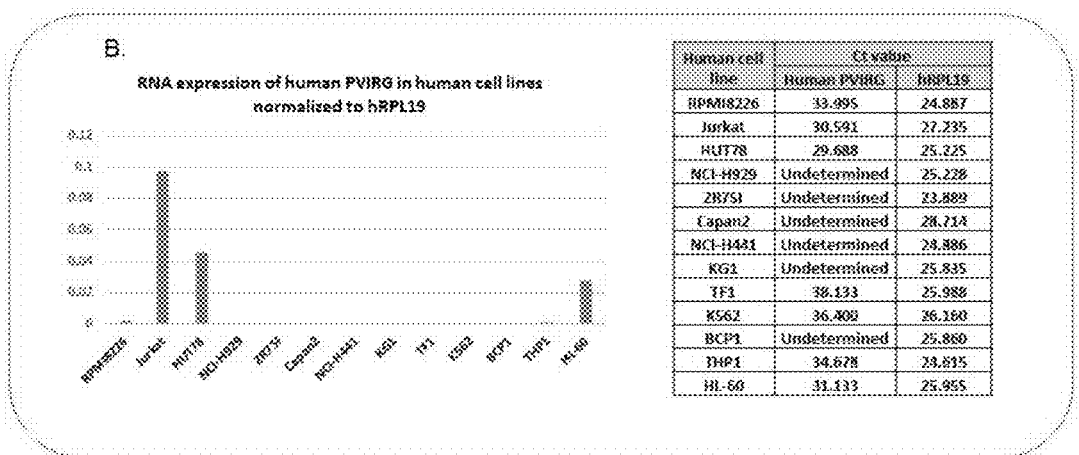
Figure 56C:
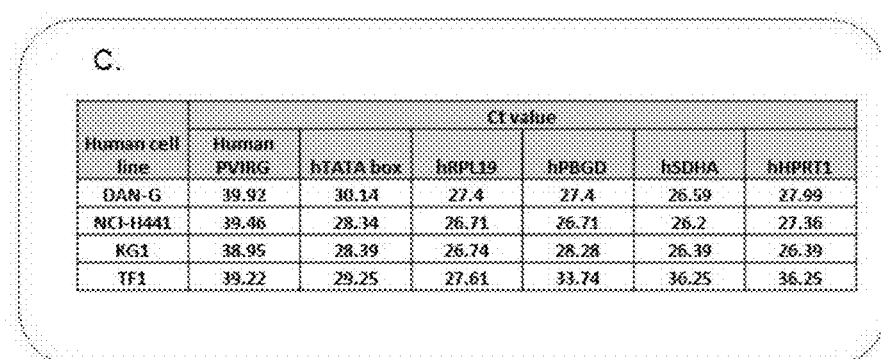

Results: Endogenous expression of the PVRIG transcript in human and mouse cell lines by qRT-PCR Human Cell Lines:

In order to verify the presence of the PVRIG transcript in human cell lines (listed in FIG. 54), qRT-PCR was performed using a specific TaqMan probe as describe above in Material & Methods. As shown in FIGS. 56A-56C. human PVRIG transcript is observed using TaqMan probe Hs04189293_g1 with relatively high levels in Jurkat (A, B), HUT78 (A, B) and HL60 (B) cell lines. Lower transcript level is observed in THP1, RPMI8226 (B) cell lines. All other cell lines show very low to no transcript.

Figure 57A:
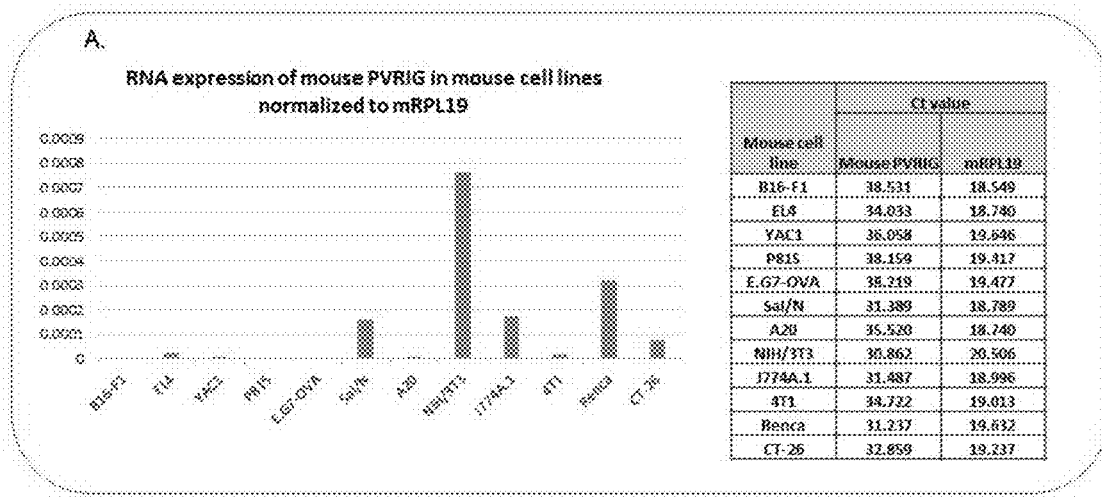
FIGS. 57A-57B Transcript expression of mouse PVRIG in various mouse cell lines. Verification of the mouse transcript in several cell lines was performed by qRT-PCR using TaqMan probe. Column diagram represents data observed using TaqMan probe CC70L8H. Ct values are detailed in the table. Analysis indicating high transcript in NIH/3T3, Renca, SaI/N and J774A.1, and lower levels in CT26 and B104-1-1 cell lines.
Figure 57B:
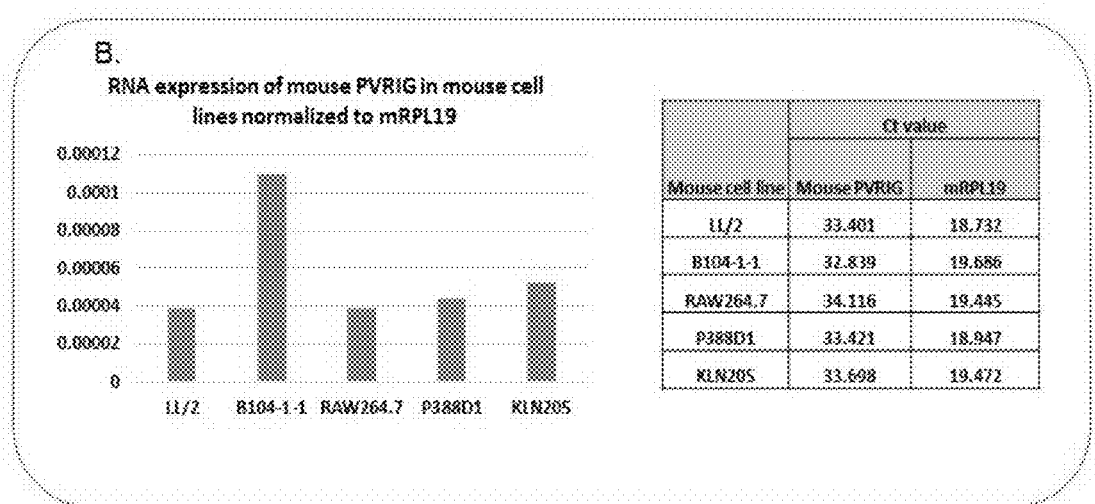

Endogenous Expression of the PVRIG Transcript in Mouse Cell Lines by qRT-PCR:

In order to verify the presence of the PVRIG transcript in mouse cell lines (listed in FIG. 55), qRT-PCR was performed using a specific TaqMan probe as describe above in Material & Methods. As shown in FIGS. 57A-57B mouse PVRIG transcript is observed using TaqMan probe CC70L8H with relatively high levels in NIH/3T3, Renca, SaI/N and J774A.1 (A), cell lines. Lower transcript level is observed in CT26 (A) and B-104-1-1(B) cell lines. All other cell lines show very low transcript.

Figure 58:
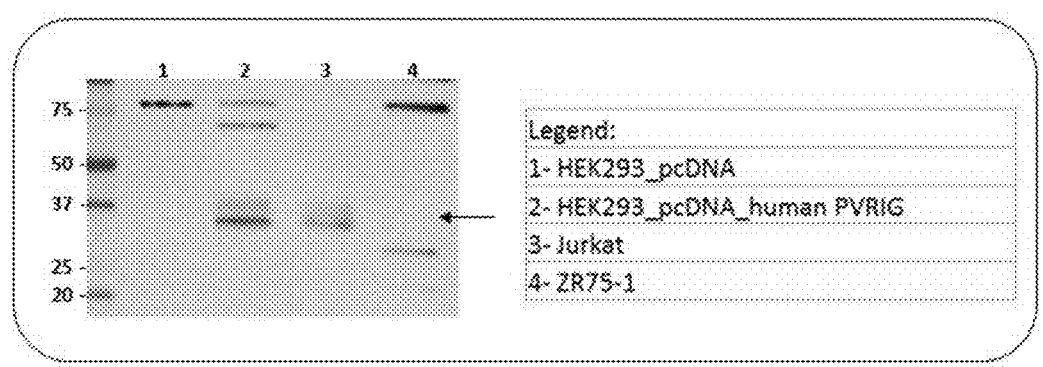
FIG. 58 Endogenous expression of PVRIG protein was analyzed by WB with the commercial anti-human PVRIG rabbit polyclonal antibody (Sigma, cat#HPA047497), using whole cell extracts of various cell lines. Extracts of HEK293 cells ectopically over-expressing human PVRIG (lane 2) or cells transfected with empty vector (lane 1), were used as positive and negative controls, respectively.

Endogenous Expression of the PVRIG Proteins in Human Cell Lines by WB:

WB analysis for endogenous expression of PVRIG protein was carried out on various human cancer cell lines lysates as detailed in FIG. 54 using commercial anti human PVRIG pAb (Sigma, HPA047497) as described in Materials & Methods above. As a positive control, whole cell extract of stable HEK293 cell pool over-expressing PVRIG was used while cells transfected with an empty vector served as the negative control. As shown in FIG. 58, a protein band corresponding to ~35 kD was detected in the positive control HEK293 over expressing cells (lane 2), as well as in the Jurkat cell line (lane 3). No expression of human PVRIG was detected in the empty vector cells (lane 1) which served as a negative control nor in ZR75-1 human cell line (lane 4).

Endogenous Expression of the PVRIG Proteins in Human and Mouse Cell Lines by FACS:

Human cell line: To verify the cell-surface endogenous expression of human PVRIG, various human cell lines (detailed in FIG. 54) were tested as described in Material & Methods above. The cell lines were stained with the commercial Ab (Abnova) or with Isotype control followed by a secondary goat anti mouse PE Ab. Analysis was performed by FACS. Binding of Abnova antibody was observed in Jurkat human cancer cell line as compared to isotype control binding. No binding of Abnova Ab was observed in the other tested cell lines: For Capan2 and ZR75-1 as compared to isotype control binding, additional FACS analysis was done using Sigma commercial Ab on a various human cell lines (Jurkat, HUT78, Karpas299 and NK-YTS), binding was observed in Jurkat cells only but no binding was observed to other cell lines (data not shown).

Further analysis for endogenous confirmation of human PVRIG in Jurkat cell line, was done by testing binding of various monoclonal antibodies of the invention. Jurkat cell line was stained with five anti-human PVRIG custom mAbs (CPA.7.024, CPA.7.050, CPA.7.005, CPA.7.002 and CPA.7.021) conjugated to AF647 or with relative Isotype control Ab conjugated to AF647 Analysis was performed by FACS. The expression of human PVRIG in Jurkat human cell line was observed by CPA.7.021 and CPA.7.050 only, as compared to isotype control expression. No binding for human PVRIG was observed in Jurkat cell line by using the other three mAbs.

Mouse Cell Line:

to verify the cell-surface endogenous expression of mouse PVRIG, various mouse cell lines: J774A.1, NIH/3T3, SaI/N and Renca (detailed in FIG. 55), were tested as described in Material & Methods above. The cell lines were stained with the custom polyclonal rat anti mouse PVRIG Ab (Aldevron), or with Isotype control (Aldevron) followed by a secondary goat anti rat PE Ab. Analysis was performed by FACS. No binding for mouse PVRIG protein was observed in either of the tested mouse cell lines by Aldevron polyclonal Ab (data not shown).

Knock Down of Human PVRIG in Human Cell Lines:

In order to further confirm endogenous expression of PVRIG protein in Jurkat cell line, human PVRIG siRNA pool was used for knock down as described in Material & Methods. 48 hours post siRNA transfection, cells were harvested for further analysis by qRT-PCR and by FACS.

Figure 59:
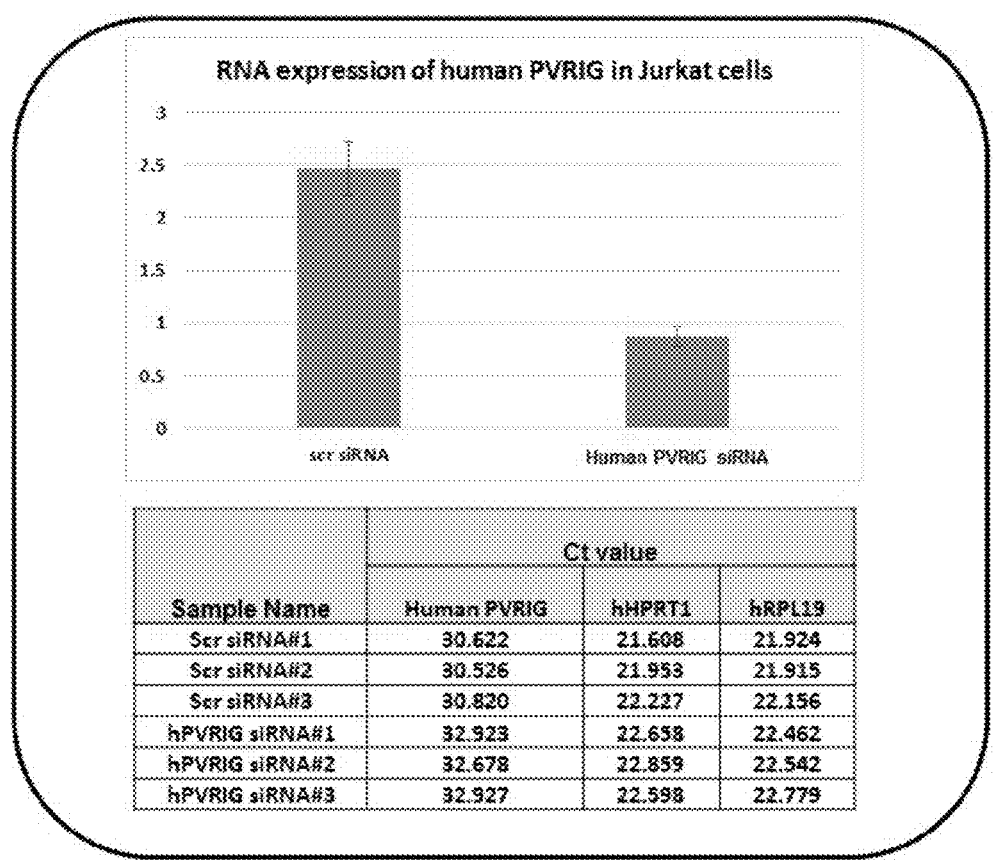
FIG. 59 qRT-PCR analysis of human PVRIG transcript in Jurkat cell line transfected with PVRIG siRNA. Jurkat human cancer cell line, transfected with human PVRIG siRNA or with scrambled siRNA were analyzed by qRT-PCR using human PVRIG TaqMan probe #Hs04189293_g1, and was normalized with geo-mean of two housekeeping genes indicated in table above. Ct values are detailed in the table. Standard deviation of technical triplicates of the PCR reaction are indicated.

Knock down of human PVRIG in human cell lines tested by qPCR: As shown in FIG. 59 human PVRIG transcript level in Jurkat cells transfected with human PVRIG siRNA pool is significantly reduced (right histogram bar) as compared to cells transfected with scrambled siRNA (left histogram bar) analyzed by qRT-PCR as described in Material & Methods.

Figure 60:
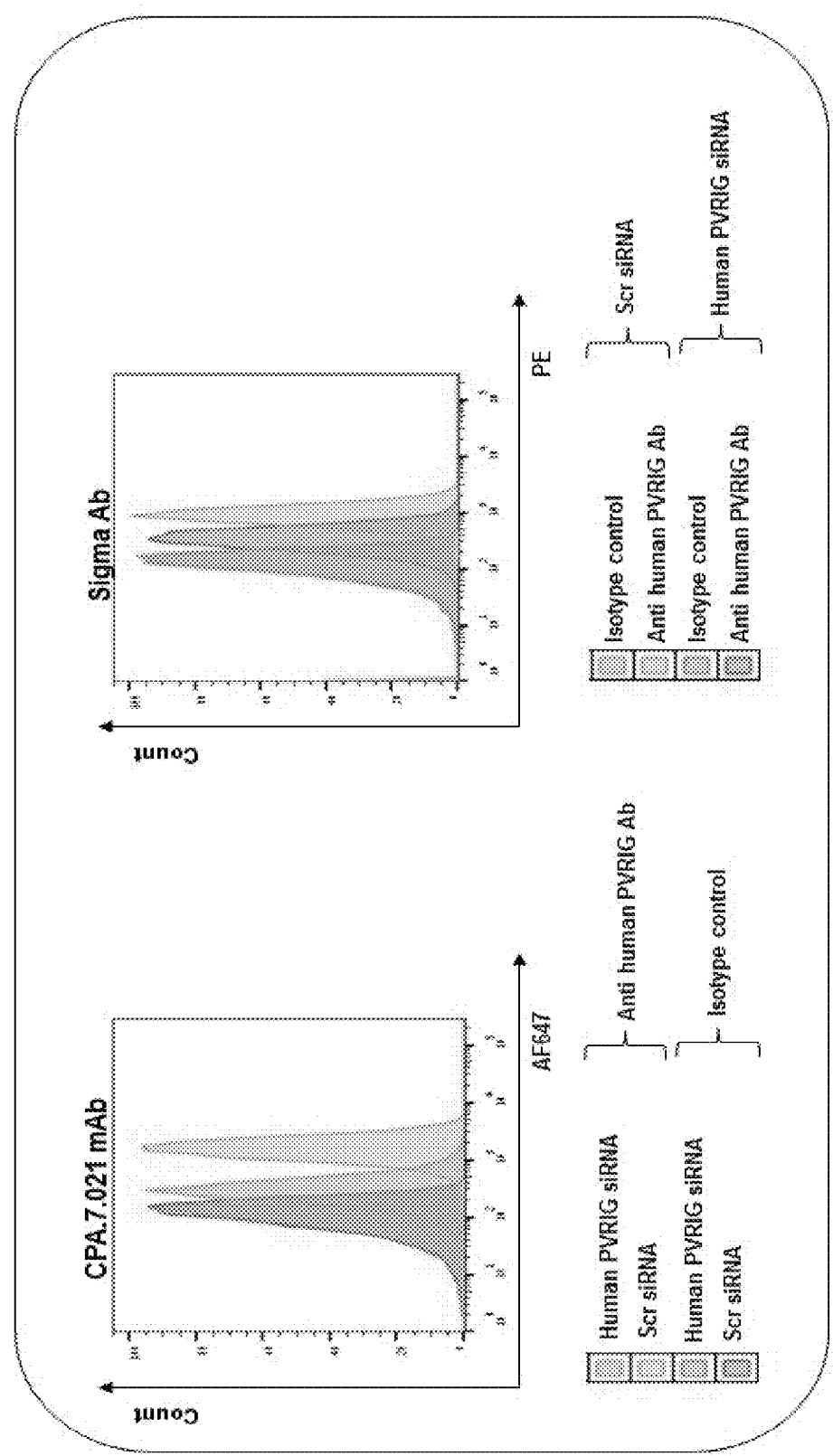
FIG. 60 Membrane expression of human PVRIG protein in Jurkat human cell line transfected with human PVRIG siRNA. Jurkat cells transfected with Human PVRIG siRNA were stained with monoclonal anti-PVRIG Ab Inc, CPA.7.021 (left panel, green line) or with IgG2 isotype control antibody (left panel, blue line) and with Sigma Ab (right panel, red line) or with IgG (right panel, blue line). Cells transfected with Scrambled siRNA were stained with the same anti-PVRIG (orange) or isotype control (left panel red line for mAb staining; right panel green line for Sigma Ab). Following cell washing, PE-Goat anti-mouse secondary conjugated Ab was added to Sigma Ab only.
Figure 68:
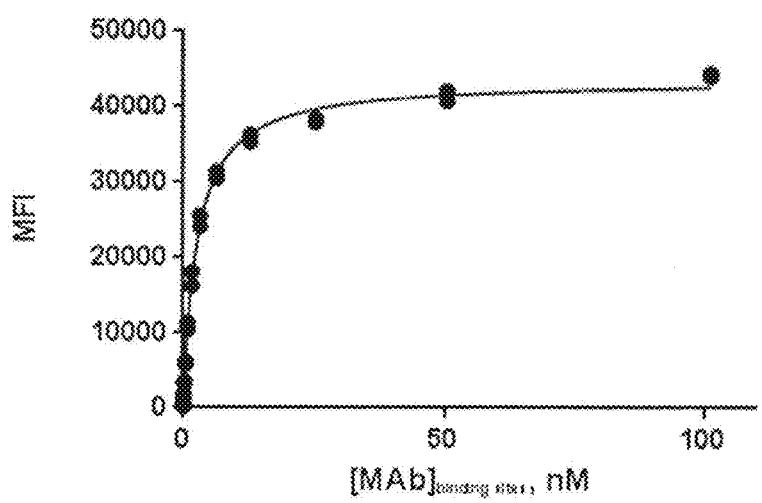
FIG. 68 depicts the binding curve for CPA.7.021 as shown in EXAMPLE 13.
Figure 69A:
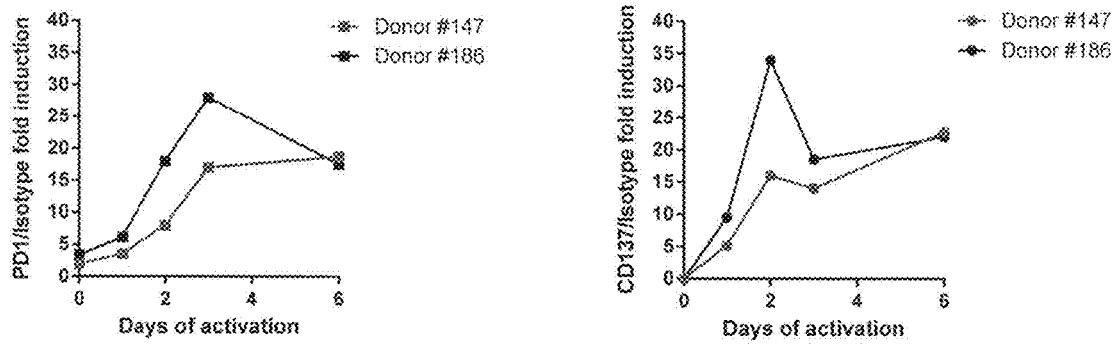
FIGS. 69A-69C Detection of CD137 and PD-1 surface expression. CD8+ T cells, CD4+ T cells and TILs were activated and monitored over time at 4 time-points as described in M&M. Resting or activated cells were first gated for lymphocytes (FSC-A vs. SSC-A), followed by live cells gate, further gated for singlets (FSC-H vs. FSC-A), CD4/CD8 positive cells and further gated for CD137 and PD1. Surface expression of PD-1 (left) and CD137 (right) on (A) CD8+ T cells (B) CD4+ T cells and (C) TILs at different time-points normalized to isotype control over the time course of activation.
Figure 69B:
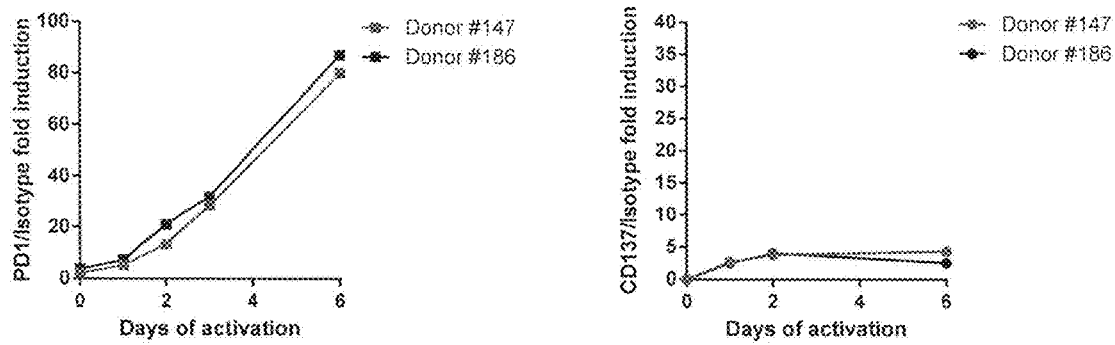
Figure 69C:
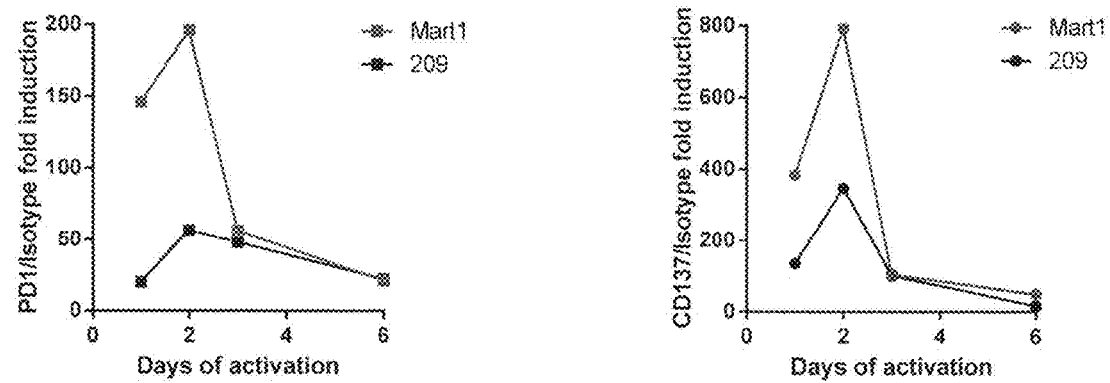

Knock down of human PVRIG in human cell lines tested by FACS: Further analysis of human PVRIG membrane expression in the same siRNA transfected cells was performed by FACS. As shown in FIG. 60 membrane expressions of human PVRIG protein is reduced in cells transfected with PVRIG siRNA (green for CPA.7.021mAb or red for Sigma Ab) as compared to cells transfected with scrambled siRNA (orange). The fold change (anti PVRIG vs, Isotype control) in Jurkat cell line is decreased from 8 fold to 3.3 fold by using Sigma Ab, or from 15.3 fold to 2.8 fold by using CPA.7.021 mAb.

This report includes preliminary data on PVRIG endogenous expression in cell lines both at the RNA level and the protein level in human and mouse cell lines.

Various human cancer cell lines were tested by qRT-PCR, WB and FACS for endogenous expression of PVRIG.

Cell surface expression of human PVRIG was observed in Jurkat cell line by using the commercial polyclonal Abs (Sigma and Abnova) and the mouse monoclonal Abs (Inc), as shown in FIGS. 4A and 4B respectively. These observations are in correlation to RNA transcript levels as shown in FIGS. 1A & B, and to WB results as shown in FIG. 3.

Figure 5A:
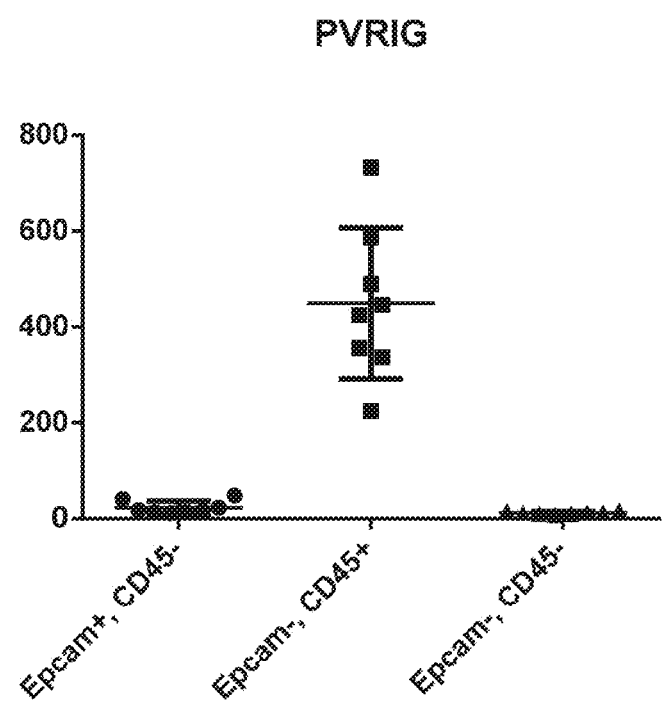
FIGS. 5A, 5B and 5C presents mRNA expression of PVRIG in specific cell populations.
Figure 5B:
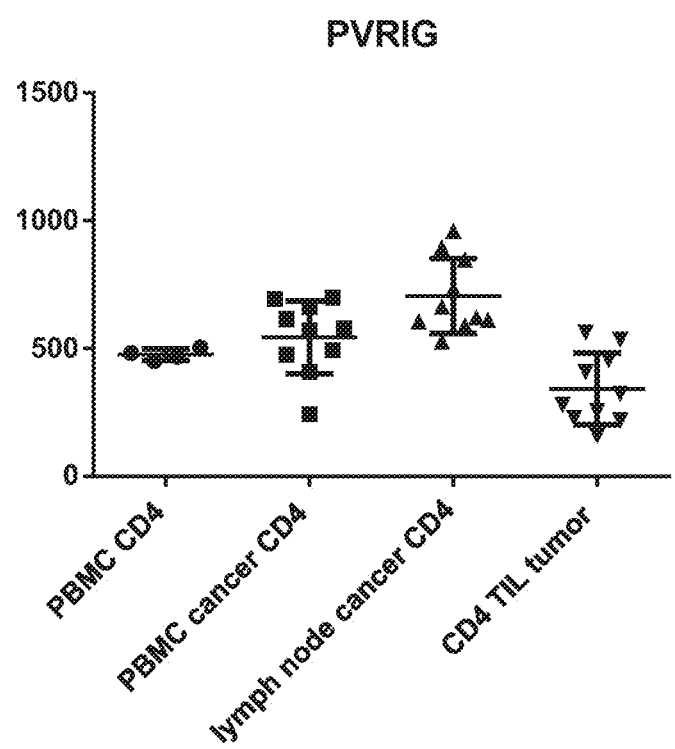
Figure 5C:
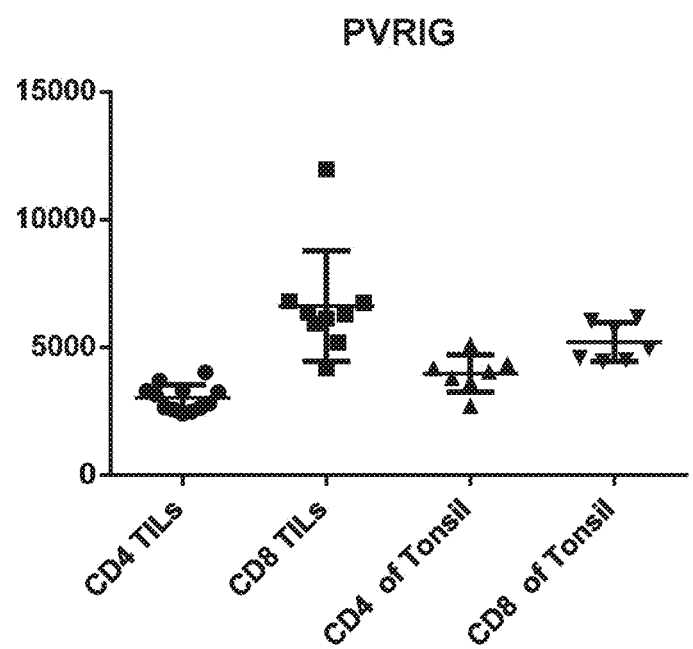

Additional confirmation of endogenous human PVRIG in Jurkat cell lines was done by knock down experiment confirming clear reduction in the RNA transcript following PVRIG siRNA transfection, as shown in FIGS. 5A-5C, and also reduction was observed in the protein cell surface expression in Jurkat cell lines as shown in FIG. 6 by commercial Ab and by monoclonal Ab.

Various mouse cell lines were tested by qRT-PCR and FACS for endogenous expression of PVRIG. In the transcript level, presence of PVRIG was observed in J774A.1, NIH/3T3, SaI/N and Renca cell lines as shown in FIGS. 2A & B. Although no membrane expression of mouse PVRIG was observed in these tested cell lines detected by polyclonal Ab (Aldevron) (data not shown). FIG. 61 and FIG. 62 indicate the summary of the findings described in this report, highlighting the cell lines showing correlation between qPCR and FACS, confirmed by knock down.

Example 1H

The aim of this experiments is to evaluate the expression of PVRIG protein on resting or activated human (Tumor infiltrating lymphocytes) TILs isolated from human melanoma samples and propagated in the presence of melanoma specific antigens and IL2. Human mAb were produced directed against the extracellular domain (ECD) of human PVRIG. These Abs were directly labeled with Alexa flour 647 in order to examine the expression of PVRIG on cells by FACS analysis.

Materials and Methods

TILs:

In this experiments series three different Tumor-infiltrating lymphocyte (TIL) from resected metastases of three melanoma patients were used: 1) TIL-412-HLA-A2-Mart1 specific; 2) TIL-F4-HLA-A2-gp100 specific, and 3) TIL-209-HLA-A2-gp100 specific. Human TILs (>90% CD8+), were thawed 24 h prior to beginning of experiment. Cells were thawed in 12 ml of TIL medium (IMDM+10% human serum+1% Glutamax+1% Na-Pyruvate+1% non-essential amino acids+1% Pen-Strep) supplemented with 300 U/ml of rhIL2 (Biolegend 509129). Cells were left to recover from freezing for 24 hours.

Assay Conditions:

After recovery, TILs were tested in four different conditions: 1) Resting—with 300 U/ml of IL2 (Biolegend cat-589106), 2) With polyclonal activation of T cells, using 1 µg/ml of plate bound anti CD3 antibody (eBioscience clone OKT3, cat-16-0037-85)+2 µg/ml of anti CD28 ab (eBioscience clone CD28.2 cat-16-0289-85)+300 U/ml of IL2. 3) Co-cultured (1:1) with Mel888 (LIMS ID: CL-216) melanoma cells (HLA-A2 negative) and 4) Co-cultured (1:1) with Mel624 (LIMS ID CL-218) melanoma cells (HLA-A2+ Mart1/gp100 positive).

After 12 hours of resting/activation/co-culture, cells were tested by FACS for PVRIG expression as well as the expression of other members of PVRIG pathway and other surface markers.

Staining Cells:

Cells were harvested after 12 hours and washed twice with PBS. Cells were stained in room temp for 20 minutes with PBS supplemented with 1/1000 of fixable viability stain efluor 450 (BD horizon cat-562247). After staining, cells were washed twice with PBS and stained for 15 minutes on ice with FACS buffer (PBS+0.5% BSA+2 mM EDTA+0.05% Azide) supplemented with 1/25 of human Truestain FC-Block (Biolegend, 422302). After FC-blocking, cells were stained on ice for 30 minutes with the Abs and concentrations that are listed in table 1.

PVRIG is Expressed on Human Resting TILs:

Resting TILs, cultured for 12 hours with 300 U/ml of IL2 only, were stained for PVRIG expression and analyzed by FACS. Gating strategy for TILs: Lymphocytes were gated first according to size and granularity in FCS:SSC graph, than single cells were gated according to FSC-H and FSC-A, than live cells were gated according to viability Dye staining in Vioblue:FSC graph, than CD8+ cells were gated according to CD8 staining in CD8:FSC graph. Expression levels of PVRIG was than plotted according to PVRIG staining in histograms.

PVRIG Expression on Human TILs is Downregulated Upon Activation with Anti CD3+ Anti CD28 Abs:

Human TILs, cultured for 12 hours with anti CD3+ anti CD28 abs+IL2 were stained for PVRIG expression and analyzed by FACS. PVRIG expression on surface of all three TILs examined is downregulated upon activation, comparing to resting TILs (data not shown).

PVRIG Expression on Human TILs is Slightly Downregulated Upon Co-Culture with Mel888:

Human TILs, co-cultured for 12 hours with Mel888 cells were stained for PVRIG expression and analyzed by FACS. PVRIG expression on surface of all three TILs examined is slightly downregulated upon co-culture with Mel888 comparing to resting TILs.

PVRIG Expression on Human TILs is Downregulated Upon Co-Culture with Mel624:

Human TILs, co-cultured for 12 hours with Mel624 cells were stained for PVRIG expression and analyzed by FACS.PVRIG expression on surface of all three TILs examined is slightly downregulated upon co-culture with Mel624 comparing to resting TILs.

Expression of Other Pathway Members on Resting TILs:

Human TILs, co-cultured for 12 hours with IL2 only were stained for the expression of CD96, PVR, PVRL2, TIGIT and DNAM1 and analyzed by FACS. CD96, TIGIT and DNAM1 is expressed on all three examined TILs. PVR is expressed on the surface of all three TILs as well but to

| Antibodies | Isotype | Conjugated to | Manufacturer | Catalog number | concentration (ug/ul) | Staining concentration |
|---|---|---|---|---|---|---|
| Anti-human PVRIG-CPA.7.021 | Human IgG2 | AF-647 | Compugen-iNC | CPA.7.021 | 0.2 | 5 µg/ml |
| Human IgG2 isotype control | Human IgG2 | AF-647 | Compugen-iNC | | 0.2 | 5 µg/ml |
| CD96 | mIgG1 | APC | Biolegend | 338410 | 0.2 | 4 µg/ml |
| PVR | mIgG1 | APC | Biolegend | 337618 | 0.05 | 1 µg/ml |
| PVRL2 | mIgG1 | APC | Biolegend | 337412 | 0.1 | 2 µg/ml |
| TIGIT | mIgG1 | APC | eBioscience | 17-9500-42 | 0.025 | 0.5 µg/ml |
| DNAM1 | mIgG1 | APC | Biolegend | 338312 | 0.1 | 2 µg/ml |
| PD1 | mIgG1 | AF647 | Biolegend | 329910 | 0.1 | 2 µg/ml |
| CD8 | mIgG1 | FITC | Biolegend | 300906 | 0.15 | 3 µg/ml |

After staining, cells were washed once and re-suspended in FACS buffer for analysis. Compensation calibration was done using compensation beads (BD, 552843). One drop of beads were stained for 30 minutes with above antibodies. Beads staining was done with same concentrations as cell staining. After beads staining, compensation was performed on MacsQuant FACS machine according to standard procedure. All samples were acquired on a MACSQuant analyzer (Miltenyi) and data was analyzed using Tree Star FlowJo software (v10.0.8).

relatively low levels. PVRL2 is not detected on any of the TILs.

Expression of Other Pathway Members on TILs Activated with Anti CD3 and Anti CD28 abs:

Human TILs, cultured for 12 hours with anti CD3 and anti CD28 abs were stained for the expression of CD96, PVR, PVRL2, TIGIT and DNAM1 and analyzed by FACS. Upon activation with anti CD3+ anti CD28 abs, CD96 is downregulated, PVR is slightly upregulated, TIGIT is slightly upregulated and DNAM1 is upregulated as well.

Expression of Other Pathway Members on TILs Co-Cultured with Mel888:

Human TILs, co-cultured for 12 hours with Mel888 cells were stained for the expression of CD96, PVR, PVRL2, TIGIT and DNAM1 and analyzed by FACS. Upon co-culture with Mel888, CD96 is downregulated, PVR is highly upregulated, TIGIT and DNAM1 is downregulated, PVRL2 is slightly induced as well.

Expression of Other Pathway Members on TILs Co-Cultured with Mel624:

Human TILs, co-cultured for 12 hours with Mel624 cells were stained for the expression of CD96, PVR, PVRL2, TIGIT and DNAM1 and analyzed by FACS. Gating strategy was done according to FIG. 1. Upon co-culture with Mel624, CD96 is downregulated, PVR is highly upregulated, TIGIT is stable or slightly upregulated, DNAM1 is downregulated and PVRL2 is slightly induced.

Figure 16:
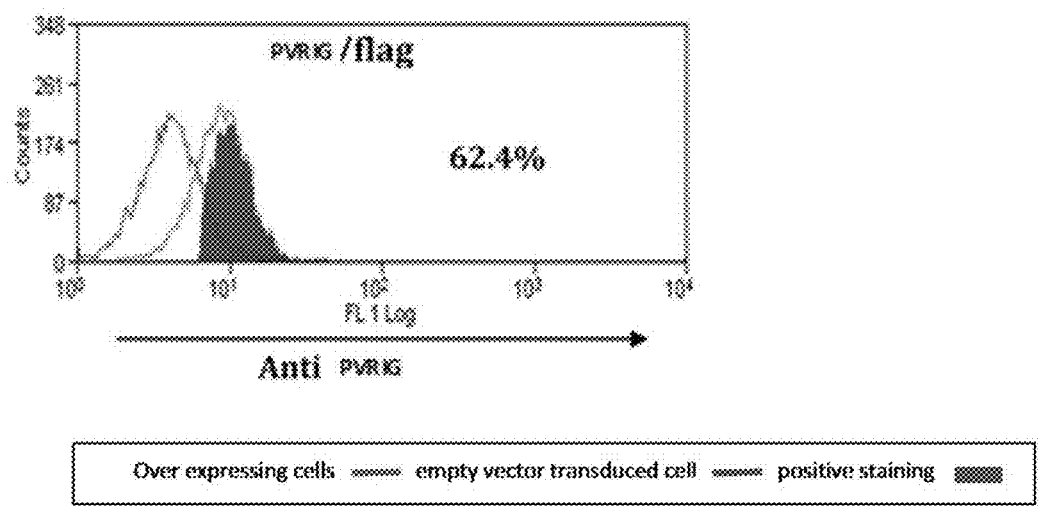
FIG. 16 presents FACS analysis on PVRIG transduced PBLs using a specific antibody. The percent of cells staining positive (relative to empty vector transduced) for the protein is provided.
Figure 17:
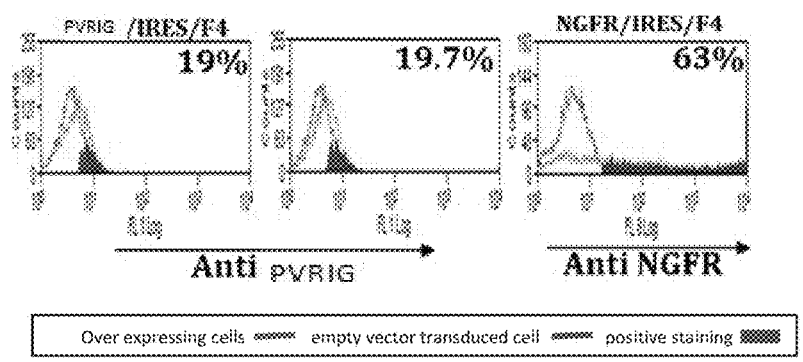
FIG. 17 presents FACS analysis on PVRIG (either co-expressed with F4 TCR or in a bi-cystronic vector with F4 TCR and NGFR transduced PBLs using a specific antibody. The percent of cells staining positive (relative to empty vector transduced) for the protein is provided.

Expression of PD1 on TILs:

Human TILs, cultured for 12 hours with IL2 only or activated with anti CD3+ anti CD28 abs or co-cultured with Mel888 or with Mel624 cells were stained for the expression of PD1 and analyzed by FACS. As can be seen in FIG. 16 and FIG. 17, PD1 is expressed on resting TIL412 only. No change in PD1 expression is noticed upon co-culture with Mel888, But, PD1 is upregulated in all three TILs upon co-culture with Mel624 or upon activation with anti CD3+ anti CD28 abs.

Summary and Conclusions:

For all TILs that were tested:

Anti PVRIG-CPA.7.021 ab stains TILs (up to 2.6 fold)

PVRIG expression is downregulated upon activation of 12 hours with anti CD3+ anti CD28 abs or upon co-culture with Mel624 (almost to background level).

Resting TILs express CD96, TIGIT and DNAM1(up to 35, 12 and 79 fold respectively)

CD96 expression is downregulated upon activation (from up to 35 to ~11 fold) or co-culture with irrelevant (HLA-A2-) melanoma DNAM1 expression is upregulated upon activation with αCD3/CD28 abs (from up to 79 to 102 fold) but strongly downregulated upon co-culture of TILs with Mels (down to 8 fold).

TIGIT expression is slightly downregulated upon co-culture of TILs with mel888 cell line, and was stable with a slight upregulation upon co-culture with Mel624 or activation with anti CD3+ anti CD28 abs.

PD1 expression is upregulated upon activation (from 0 up to 18 fold)

High levels of PVR were detected following TILs co-culture with melanomas (from <2 up to 18 fold).

Resting TIL-412 show positive staining for PD1. TIL-F4 is also slightly positive for PD1 whereas TIL-209 is negative. Summary of changes in expression levels of all parameters tested, in the different conditions can be seen in Table 2.

TABLE 2

|  | +IL2 | +αCD3 + αCD28 + IL2 | +Mel888 | +Mel624 |
|---|---|---|---|---|
| PVRIG | 1.4-2.6 | 0-12 | 1.3-1.7 | 0-1.2 |
| CD96 | 23-35 | 12.7-16 | 11.7-17.6 | 11.1-16.6 |
| TIGIT | 5.7-12.6 | 7.8-12.5 | 4-7.3 | 6.1-12.5 |
| DNAM1 | 43-79 | 56-100 | 14-20 | 17-25 |
| PVR | 1.6-1.8 | 2.6-3.2 | 13.6-18 | 11-17 |
| PVRL2 | 0 | 0 | 1.4-2.3 | 1.2-1.8 |
| PD1 | 0-4.5 | 2.3-18.4 | 0-4.6 | 2-9.3 |

Example 1I: Expression of PVRIG on Resting and Activated Human T Cells and TILS

The aim of this example was to evaluate the expression of PVRIG protein on resting and activated human isolated primary CD4+ and CD8+ T cells, as well as TILs (Tumor Infiltrating Lymphocytes) isolated from human melanoma samples and propagated in the presence of melanoma specific antigens and IL2. Human mAbs were produced against the extracellular domain (ECD) of human PVRIG. These Abs were directly labeled with Alexa flour 647 in order to examine the expression of PVRIG on cells by FACS analysis.

Materials and Methods

TILs: In this series of experiments, two different TILs, from resected metastases of three melanoma patients, were used:

TIL-Mart1-HLA-A2-Mart1 specific

TIL-209-HLA-A2-gp100 specific

Human TILs (>95% CD8+), were thawed 24 h prior to beginning of experiment. Cells were thawed in 12 ml of TIL medium (IMDM+10% human serum+1% Glutamax+1% Na-Pyruvate+1% non-essential amino acids+1% Pen-Strep) supplemented with 300 U/ml of rhIL2 (Biolegend 509129). Cells were left to recover for 24 hours.

Primary T cell: In this series of experiments two different donors were used:

CD4+ and CD8+ from donor #147

CD4+ and CD8+ from donor #186

Human primary cells (>95% purity), were thawed 24 h prior to beginning of experiment. Cells were thawed in RPMI complete medium (RPMI+10% FBS+1% Glutamax+1% Na-Pyruvate+1% Pen-Strep) supplemented with 300 U/ml of rhIL2 (Biolegend 509129). Cells were left to recover for 24 hours.

Assay conditions: After recovery, cells were activated using a polyclonal activation of T cells, with 1 µg/ml of plate bound anti CD3 antibody (BD-pharmingen clone Ucht-1, cat-555329), 2 µg/ml of anti CD28 ab (eBioscience clone CD28.2 cat-16-0289-85) and 300 U/ml of IL2.

Activation was carried out for 24 h, 48 h, 72 h and 144 h.

Staining cells: Cells were harvested and washed with PBS. Cells were stained at room temperature for 10 minutes with PBS supplemented with 1/1000 of fixable viability stain efluor 450 (BD horizon cat-562247). After staining, cells were washed twice with PBS and stained with the Abs at the concentrations listed in FIG. 65 for 30 minutes on ice in FACS buffer (PBS+0.5% BSA+2 mM EDTA+0.05% Azide) and concentrations that are listed in FIG. 65. After staining, cells were washed once and re-suspended in FACS buffer for analysis.

Figure 70A:
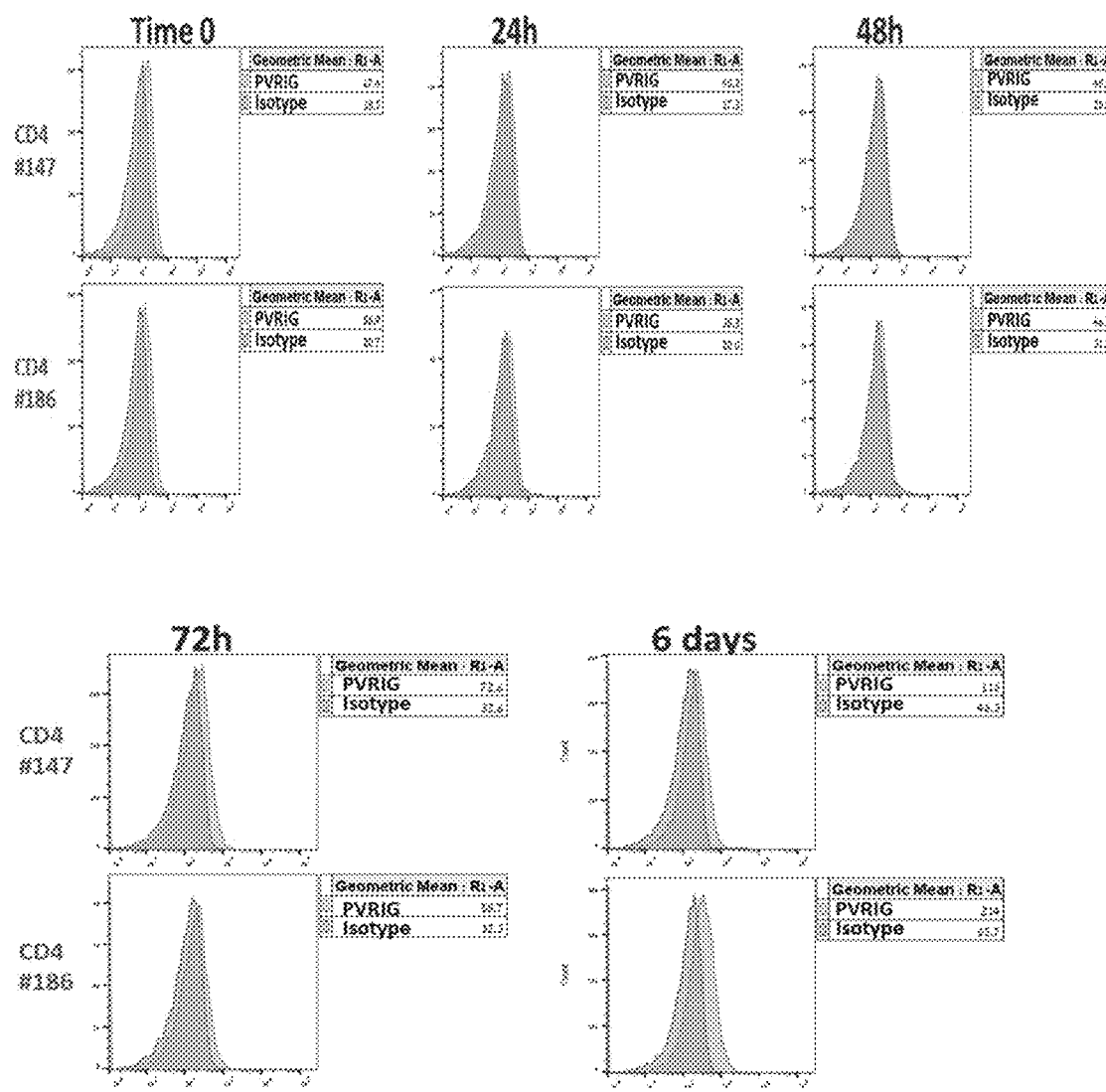
FIGS. 70A-70C PVRIG expression on resting and activated CD4+ T and CD8+ T cells. CD4+ and CD8+ T cells were activated and monitored over time at 4 time-points as described in M&M. Cells were stained with viability dye, then incubated with anti-PVRIG and isotype control (7.5 μg/ml), and evaluated by flow cytometry. (A) Expression on CD4+ T cells. Expression of PVRIG on live resting (time 0) and activated CD4+ cells following singlet gating for 24, 48, 72 h and 144 h compared to isotype control. (B) Expression on CD8+ T cells. Expression of PVRIG on live resting (time 0) and activated CD8+ cells following singlet gating for 24, 48, 72 h and 144 h compared to isotype control. Shown are the Geometric Mean of the fluorescent intensity values obtained. (C) Normalization of fold induction staining with anti-PVRIG-CPA.7.021 ab compared to human IgG2 isotype over the time course of activation.
Figure 70B:
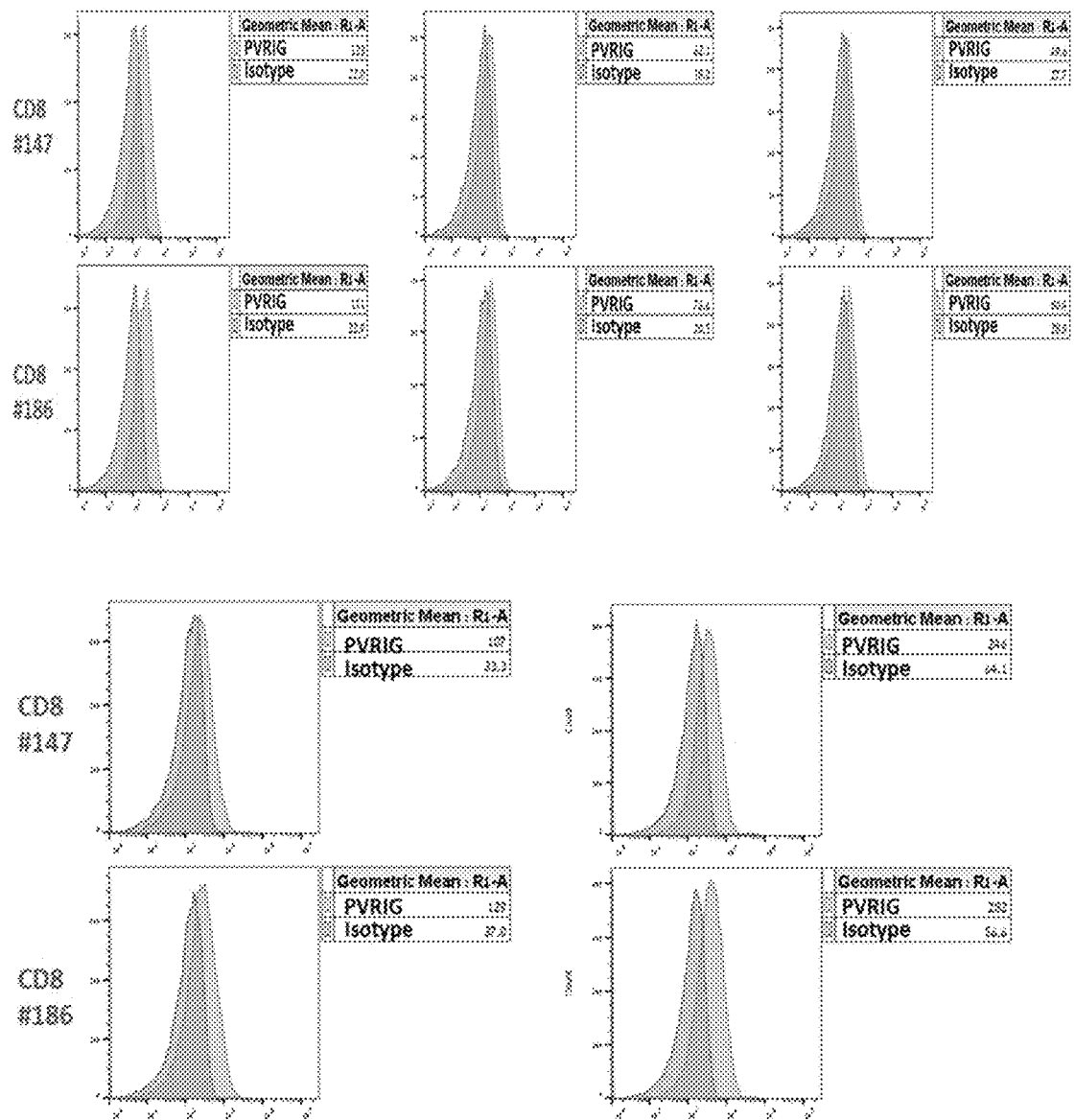
Figure 70C:
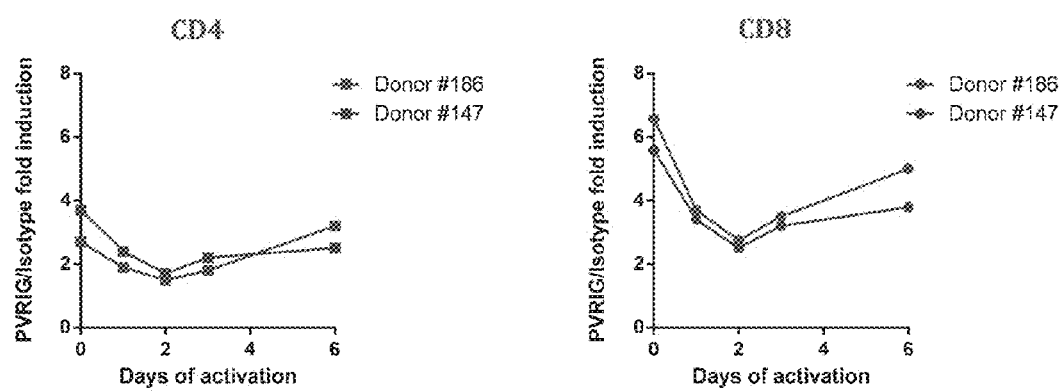

Results:

Human T cells from two different donors and TILs were left untreated (resting) or polyclonal stimulated for various timepoints as described in Materials and Methods. Cell activation state was evaluated by detection of surface expression of CD137 and PD-1 at each time point compared to isotype control (FMO), as shown for activated CD8+, CD4+ T cells and TILs (FIGS. 70A, B & C respectively). As expected, PD-1 and CD137 expression was detected and elevated upon activation (FIGS. 70A, B & C).

Figure 71A:
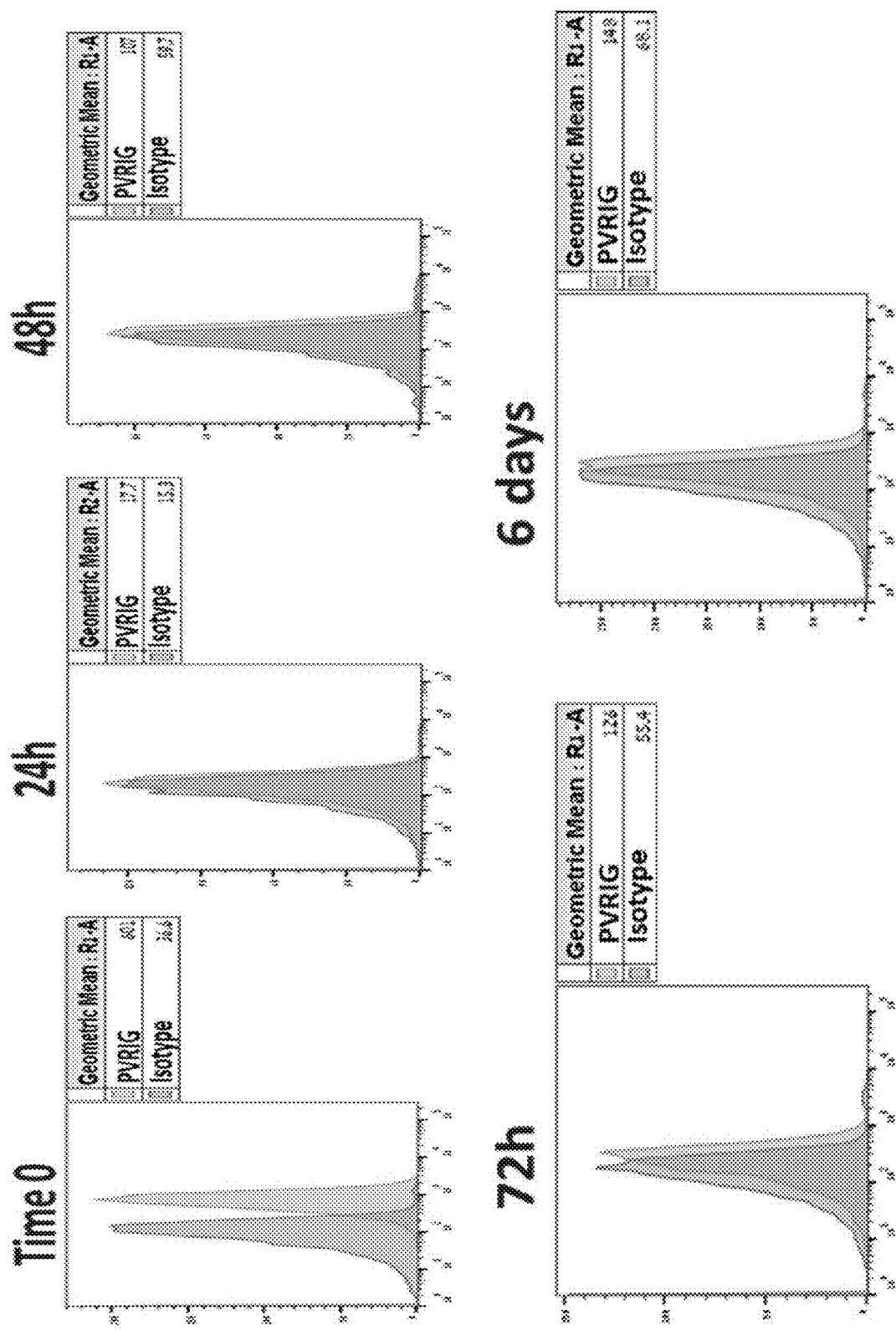
FIGS. 71A-71C PVRIG expression on resting and activated TILs. TILs Mart1 and 209 were activated and monitored over time at 4 time-points as described in M&M. Cells were stained with viability dye, then incubated with anti-PVRIG and isotype control (7.5 μg/ml), and evaluated by flow cytometry. (A) Expression on TIL Mart1. Expression of PVRIG on live resting (time 0) and activated TIL following singlet gating for 24, 48, 72 h and 144 h compared to isotype control. (B) Expression on TIL 209. Expression of PVRIG on live resting (time 0) and activated TIL following singlet gating for 24, 48, 72 h and 144 h compared to isotype control. Shown are the Geometric Mean of the fluorescent intensity values obtained. (C) Normalization of fold induction staining with anti PVRIG-CPA.7.021 ab compared with human IgG2 isotype control over the time course of activation.
Figure 71B:
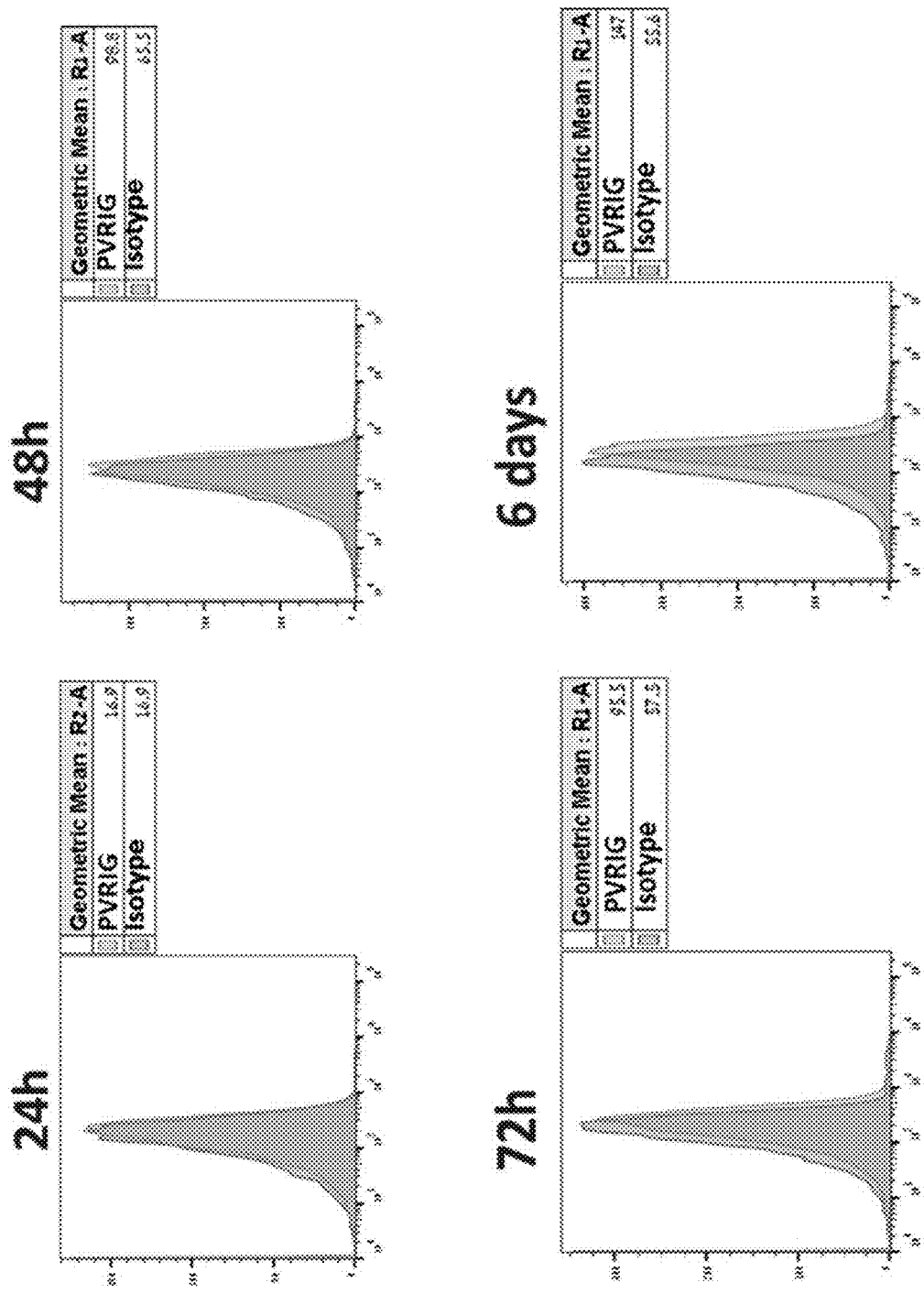
Figure 71C:
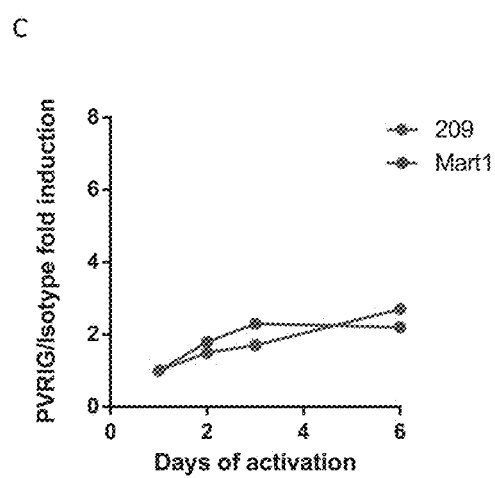

PVRIG expression was observed on both resting CD4+ and CD8+ T cells, with higher expression on CD8+ cells (6-8 fold) as compared to CD4+ cells (3 folds), and diminished upon activation (FIGS. 71A, B & C). On days 3-6 of activation, PVRIG expression was increased on CD8+ (4-5 fold) and CD4+ (2-3 fold) T cells, as can be seen in FIGS. 71A-71C.

Figure 72:
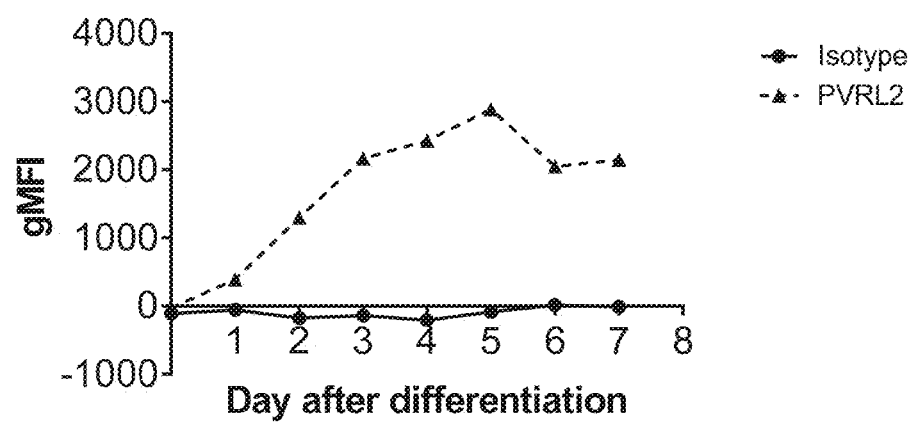
FIG. 72 Expression of PVRL2 on monocyte-derived DC. PVRL2 expression (triangles with broken line) as a function of time (days) relative to isotype control (circles with solid line) is shown. Day after differentiation indicates time after addition of GM-CSF and IL-4 to monocytes.

In addition, PVRIG expression was also observed on Mart1 and 209 resting TILs, and expression was decreased apon activation (FIGS. 721A, B & C). On day 3-6 of activation PVRIG expression was increased, as can be seen in FIG. 72, compared to day 1-2 of activation.

Example 2: Generation and Characterization of PVRIG-Expressing Stable Transfectant Cell Pools Recombinant stable pools of cell lines overexpressing PVRIG human and mouse proteins were generated, for use in determining the effects of PVRIG on immunity, for PVRIG characterization and for identifying immunoregulatory PVRIG based therapeutic agents.

Materials & Methods:
Reagents: DNA constructs:
Human PVRIG flag pUC57
Human PVRIG flag pCDNA3.1
Human PVRIG flag pMSCV
Recombinant cells:
HEK293 pCDNA3.1 Human PVRIG flag
HEK293 pMSCV Human PVRIG flag
Commercial antibodies:
Anti PVRIG, Sigma cat. HPA047497—Rabbit polyclonal
Anti-PVRIG, Abnova cat. H00079037-B01—Mouse polyclonal
Full length validation of mouse PVRIG was done using PCR reactions and sequencing of the PCR products.
Three couples of primers were used (Table 3).

Human PVRIG sequence that was subcloned into pcDNA3.1 initiate from the second methionine of human PVRIG protein, whereas the human PVRIG sequence that was subcloned into pMSCV initiate from the first methionine of human PVRIG protein.

Construct Encoding the Human PVRIG-Flag.

Full length human PVRIG gene, synthesis by GenScript was subcloned into using pcDNA3.1 using BamI and NheI restriction enzymes.

Constructs Encoding the Mouse PVRIG Proteins:

Four contracts encoding the mouse sequence were synthesize by GenScript as following:
1. First Methionine no tag
2. First Methionine with Flag
3. Second Methionine no tag
4. Second Methionine with Flag The synthesize gene were subcloned into pCDNA3.1
Generation of stable transfectants over expressing PVRIG proteins The resulting expression construct was verified by sequence and subsequently used for transfections and stable pool generation as described below. The protein sequences encoded by the expression constructs are as set forth in FIGS. 103A-103BX.

Generation of stable transfectant pools expressing human PVRIG-flag protein

HEK293 (ATCC, catalog number: CRL-1573) cells were transfected with pCDNA3.1+ human PVRIG-flag plasmid or with empty vector (pCDNA3.1+ as negative control), using FUGENE 6 Reagent (Roch, catalog number 11-988-387). Geneticin, G418 (Gibco, catalog number: 11811-031) resistant colonies were selected for stable pool generation.

TABLE 3

Sequence of primers used for mouse full length validation

| Primer name | Sequence: |
|---|---|
| 200-554_mPVRIG_F | CCACCAACCTCTCGTCTTTC (SEQ ID NO: 1531) |
| 200-553_mPVRIG_R | TCATGCCAGAGCATACAG (SEQ ID NO: 1532) |
| 200-571_mPVRIG_F | CAGTGCCTCTAACTGCTGAC (SEQ ID NO: 1533) |
| 200-572_mPVRIG_R | TCACTGTTACCAGGGAGATGAG (SEQ ID NO: |
| 200-549_mPVRIG_F | CACAGGCTGCCCATGCAAC (SEQ ID NO: 1535) |
| 200-551_mPVRIG_R | TGCCTGGGTGCTAGTGAGAG (SEQ ID NO: 1536) |
| 200-554_mPVRIG_F | CCACCAACCTCTCGTCTTTC (SEQ ID NO: 1537) |
| 200-546_mPVRIG_R | GACCCTGTTACCTGTCATTG (SEQ ID NO: 1538) |

As a templet for the PCR reaction, cDNA of NIH 3T3 cell line or a mix of three commercial cDNA panels were used:
1. cDNA panel I, Mouse, Biochain, Cat no. C8334501 (Heart, Brain, Kidney, Liver).
2. cDNA panel II, Mouse, Biochain, Cat no. C8334502 (Lung, Pancreas, Spleen, Skeletal Muscle).
3. cDNA, Clontech, Cat no. 637301, (Brain, Heart, day 7 Embrio, Testis, Spleen).

Expression Constructs

Full length cloning of human and mouse PVRIG-flag was performed by gene synthesis (GenScript) using codon optimized sequence in pUC57 vector for human transcript and non optimized for mouse transcript and subcloned into a mammalian expression vector, pcDNA3.1 or to pMSCV, to create the expression plasmid.

GP2-293 packaging cell line (Clontech cat#631458) was transfected with pMSCV-human PVRIG or with pMSCV empty vector using Lipofectamine 2000 transfection reagent (Invitrogen, catalog number 11668019). 48 hours post transfection supernatants containing virions were collected, and directly used for infection of the human cell line as follows:

HEK-293 (ATCC, CRL-CRL-1573) cells was infected with virions expressing human PVRIG or with pMSCV empty vector virions as negative control, Puromycin (Invivogen, catalog number: 58-58-2) resistant colonies were selected for stable pool generation.

Expression Validation
Expression Validation by Western Blot
Whole cell extracts of cell pool (30 ug of total protein) were analyzed by western blot. As negative control, whole cell extracts of stable cell pools transfected with the empty vector were used. For the human PVRIG-flag detection, anti-flag and anti PVRIG antibodies were used as follow:

Mouse anti Flag M2-Peroxidase, Sigma, cat. A8592 diluted 1:1000 in TTBS/5% BSA;

Anti PVRIG, Sigma cat. HPA047497—Rabbit polyclonal, diluted 1:200 in TTBS/5% BSA. Followed by Goat Anti Rabbit-HRP, Jackson, Cat: 111-035-003 diluted 1:20,000 in 5% milk/TTBS Solution.

Expression Validation by Flow Cytometry (FACS)

In order to validate the cell surface expression of the human PVRIG protein in the recombinant stable pools, $1\times10^5$ cells were stained with Fixable viability stain 450 (BD, 562247) diluted 1:1000 in PBS, for 10 min at R.T. Mouse polyclonal anti PVRIG, (Abnova, Cat.H00079037-B01) diluted 1:200 or with mouse IgG1 isotype control (Life Technologies), were then added to cells followed by staining with Goat Anti Mouse-PE (Jackson, cat.115-116-146).

Figure 24:
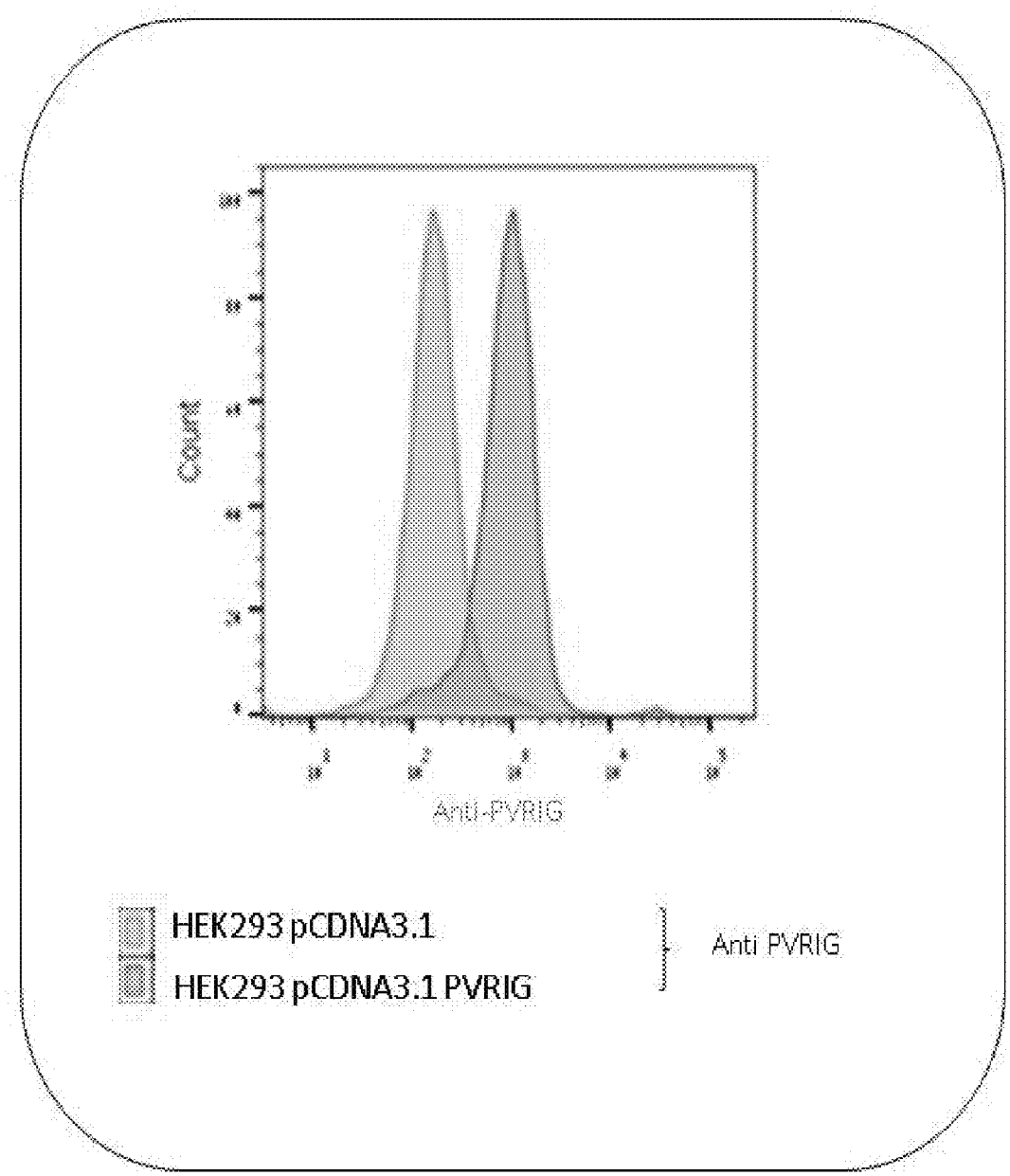
FIG. 24: Cell surface expression of HEK293 cells ectopically expressed human PVRIG-flag protein by FACS analysis. Anti-PVRIG pAb (Abnova) was used to analyze HEK293 cells stably expressing the human PVRIG-flag protein. Cells expressing the empty vector were used as negative control. Detection was carried out by Goat Anti-mouse PE-conjugated secondary Ab and analyzed by FACS.

Results Expression Validation of HEK293 Stable Pool Cells Over Expressing the Human PVRIG-Flag Protein To verify expression of the PVRIG protein in the stably transfected HEK293 cells pools, whole cell extracts were analyzed by western blot using anti-flag antibody or anti PVRIG antibodies (Abnova), as described in Material and Methods. The results, shown in FIG. 24, demonstrate a band corresponding to the expected protein size of ~33 kDa in the extracts of HEK293 cell pools expressing human PVRIG, but not in the cells transfected with the empty vector.

In order to verify cell surface expression of the PVRIG protein, HEK293 stably transfected cells over-expressing the PVRIG-flag pCDNA3.1 vector were analyzed by FACS using mouse anti-PVRIG pAb (Abnova) as described in Material and Methods. The results presented in FIG. 25 show that the binding of mouse anti-PVRIG pAb to cells stably expressing the human PVRIG-flag (gray) is higher than that observed with cells transfected with the empty vector (light gray).

Example 3: PVRIG-ECD Ig Fusion Protein Production

PVRIG mECD-mIg fusion protein (see FIGS. 103A-103BX), composed of the ECD of mouse PVRIG fused to the Fc of mouse IgG2a, was produced at ProBioGen (Germany) in CHO-DG44 cells by culturing stable cell pools for 12 days, followed by Protein A purification of cell harvest and preparative SEC purification for aggregate removal. The final product was formulated in 5 mM Na citrate, 5 mM Na/K phosphate, 140 mM NaCl, 0.01% Tween pH5.5.

Expression vector used was ProBioGen's PBG-GPEX6. PVRIG gene is driven by CMV/EF1 hybrid promoter followed by polyadenylation signal pA-1. The vector contains puromycin N-acetyl-transferase gene that allows selection of transfected cells using puromycin, as well as dehydrofolate reductase gene that allows selection of transfected cells using methotrexate (MTX).

PVRIG hECD-hIg fusion protein (see FIGS. 103A-103BX), composed of the ECD of human PVRIG fused to the Fc of human IgG1 bearing C220, C226 and C229 to S mutations at the hinge, was produced at GenScript (China) by transient transfection in CHO-3E7 cells which were cultured for 6 days, followed by protein A purification of cell harvest. The final product was formulated in PBS pH 7.2.

Expression vector used was Mammalian Expression Vector pTT5, in which PVRIG gene is driven by CMV promoter.

Example 4: Expression of PVRIG on Human PBLs and Binding of PVRIG-Fc to Melanoma Cell Lines PVRIG is a novel immune checkpoint protein, which without wishing to be limited by a single theory functions as a CD28 like receptor on T cells. In this study, the expression of PVRIG on human peripheral blood lymphocytes and the binding of PVRIG-ECD-Ig (composed of the extra-cellular domain of human PVRIG fused to human IgG1) to melanoma cell lines was evaluated.

Materials and Methods

Three human melanoma cell lines which present the MART-1 antigen in HLA-A2 context (SK-MEL-23, Mel-624 and Mel-624.38) were used as targets for CTLs. Mel-888 which does not express HLA-A2, served as a negative control.

Buffy coats from human healthy donors were obtained from Tel Hashomer Blood Bank. Peripheral blood mononuclear cells were stimulated with PHA and cultured for 3 days, and subsequently transduced with MSCV-based retroviral vector (pMSGV1). Following transduction, cells were further grown in lymphocyte medium (Bio target medium, fetal bovine serum (10%), L Glutamine Penicillin/ Streptomicyn (100 units/ml), IL-2 300 IU) for additional 5 days.

To evaluate PVRIG expression on PBLs, cells were stained with a specific antibody for PVRIG (mouse poly clonal) at 5 µg/ml for 30 min at 4 degrees. Following washing, cells were stained with FITC conjugated Goat anti mouse mAb (1:250) (Invitrogen, Cat#A10667) in FACS buffer in the dark for 30 minutes at 4 degrees. Following two washes in FACS buffer, samples were read on a BD Bioscience FACS Calibur with a Cytek HTS.

To evaluate binding of PVRIG-Ig to the melanoma cell lines, SK-MEL-23, Mel-624, Mel-624.38 and mel-888, cells were co-cultured with F4 transduced or un-transduced (designated w/o) PBLs and subsequently stained with 20 µg/ml of the fusion protein PVRIG-Ig HH batch #125. Following two washes in FACS buffer, samples were stained with a secondary goat anti-human PE (Jackson, cat#109-116-098).

Results

Figure 11:
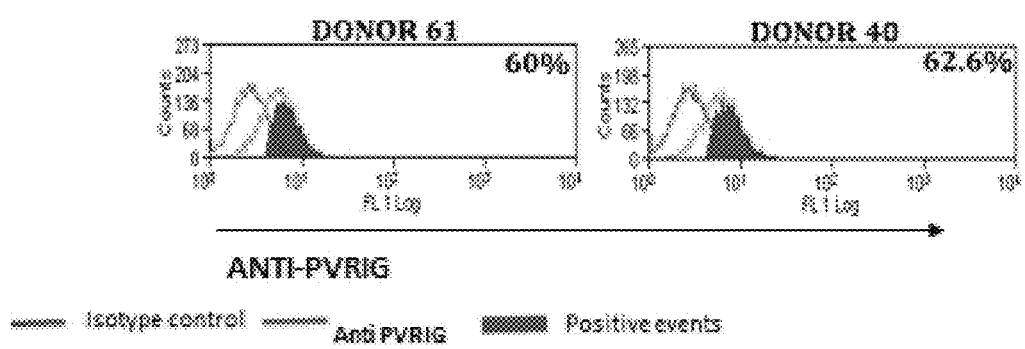
FIG. 11 shows expression of PVRIG on human PBLs. Human PBLs derived from two donors were evaluated for PVRIG expression. Both donor 61 and donor 40 showed significant staining with anti-PVRIG specific Ab.

To evaluate the endogenous expression of PVRIG on primary human leukocytes, PBLs were stimulated with PHA and subsequently transduced with an empty vector and stained with an anti-PVRIG specific antibody. As shown in FIG. 11, in two different donors staining with anti-PVRIG is observed relative to an isotype matched control.

Figure 12:
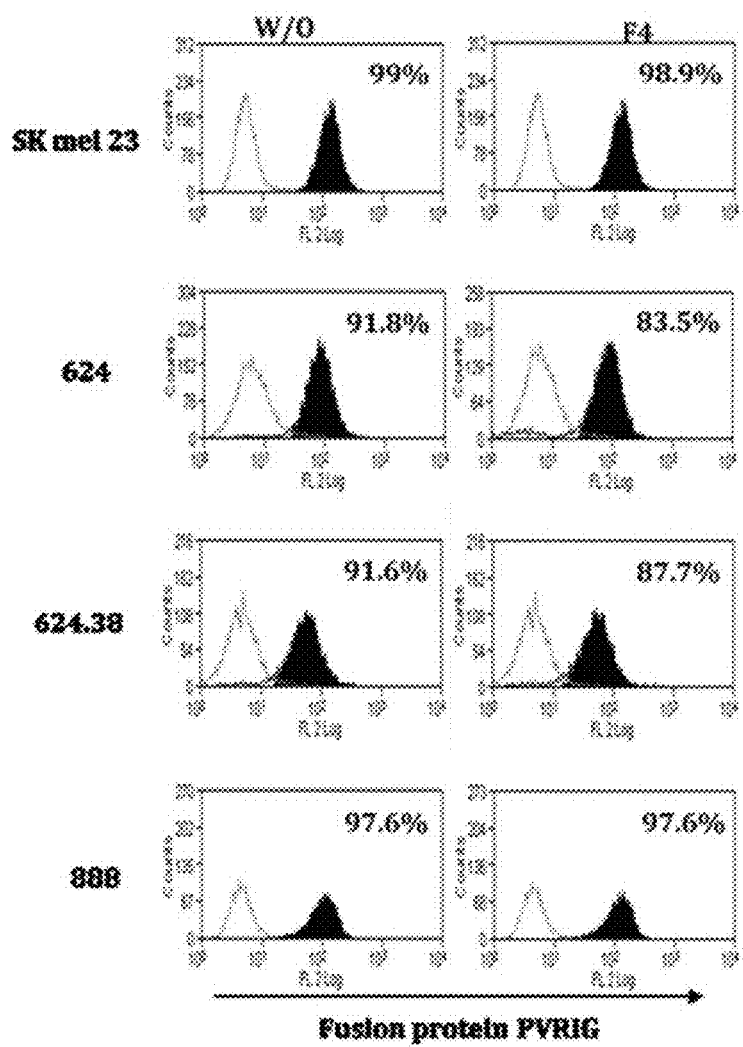
FIG. 12 shows PVRIG-Ig exhibits strong binding to all four human melanoma cell lines MEL-23, Mel-624 and Mel-624.38 and mel-888 tested. Binding is not affected by co-culture with engineered melanoma specific T cells. Grey line corresponds to isotype control, solid black line corresponds to PVRIG-ECD-Ig.

To evaluate the endogenous expression of PVRIG on melanoma cell lines and to determine whether the endogenous expression is affected by co-culture with antigen specific T cells, 4 different melanoma cell lines (SK-MEL-23, Mel-624, Mel-624.38 and mel-888) cu-cultured with PBLs either expressing or not expressing the F4 (gp100 specific TCR). Cells were subsequently stained with the fusion protein composed of the extra-cellular domain of human PVRIG fused the Fc portion of human IgG1. As shown in FIG. 12, all 4 tested human melanoma cell lines exhibit binding to PVRIG-Ig. Binding intensity is not affected by T cell dependent activation following co-culture with melanoma reactive engineered T cells.

Summary: The results presented herein suggest that PVRIG is expressed on PHA activated human primary peripheral blood leukocytes (PBLs). In addition, 4 melanoma cell lines that were tested in this study bind to the fusion protein composed of the extra-cellular domain of human PVRIG fused the Fc portion of human IgG1 suggesting that these cell lines express the counterpart for PVRIG.

Example 5: Receptor Ligand Identification and Validation

A first validation study was performed using a cell microarray technology was used to screen for interactions of PVRIG to 3559 full-length human plasma membrane proteins, which were individually expressed in human HEK293 cells.

Human HEK293 cells were grown over slides spotted with expression vectors encoding 3559 full-length human membrane proteins. An expression vector (pIRES-hEGFR-IRES-ZsGreen1) was spotted in quadruplicate on every slide, and was used to ensure that a minimal threshold of transfection efficiency had been achieved or exceeded on every slide. Human HEK293 cells were used for reverse transfection/expression. A fusion protein composed of the ECD of PVRIG fused to a human IgG1 was added at 20 µg/ml to each slide following cell fixation. Detection of binding was performed by using an appropriate fluorescent secondary antibody. Two replicate slide-sets were screened. Fluorescent images were analyzed and quantitated (for transfection efficiency) using ImageQuant software (GE).

A protein 'hit' was defined as a duplicate spot showing a raised signal compared to background levels. This was achieved by visual inspection using the images gridded on the ImageQuant software. Hits were classified as 'strong, medium, weak or very weak', depending on the intensity of the duplicate spots. To confirm the hits, all vectors encoding the hits identified in the primary screen were arrayed on new slides. Confirmation/Specificity screen and analyses was carried out as for primary screening (n=2 replicate slides per sample), except that identical slides were also probed with appropriate negative controls. Additionally, all the vectors encoding the hits were sequenced. Vectors encoding every primary hit was sequenced confirming its identity.

Background screen showed negligible binding to untransfected HEK293 cells at 2, 5 and 20 µg/ml (FIG. 13). Based upon the background data, 20 µg/ml was chosen for full profiling. Primary screen resulted in multiple duplicate hits (clones), with the majority being weak or very weak intensity. All primary hits identified, and a control EGFR-ZsGreen1 vector, were spotted and re-expressed in duplicate and probed with PVRIG at 20 µg/ml for the Confirmation/Specificity screen.

Figure 14:
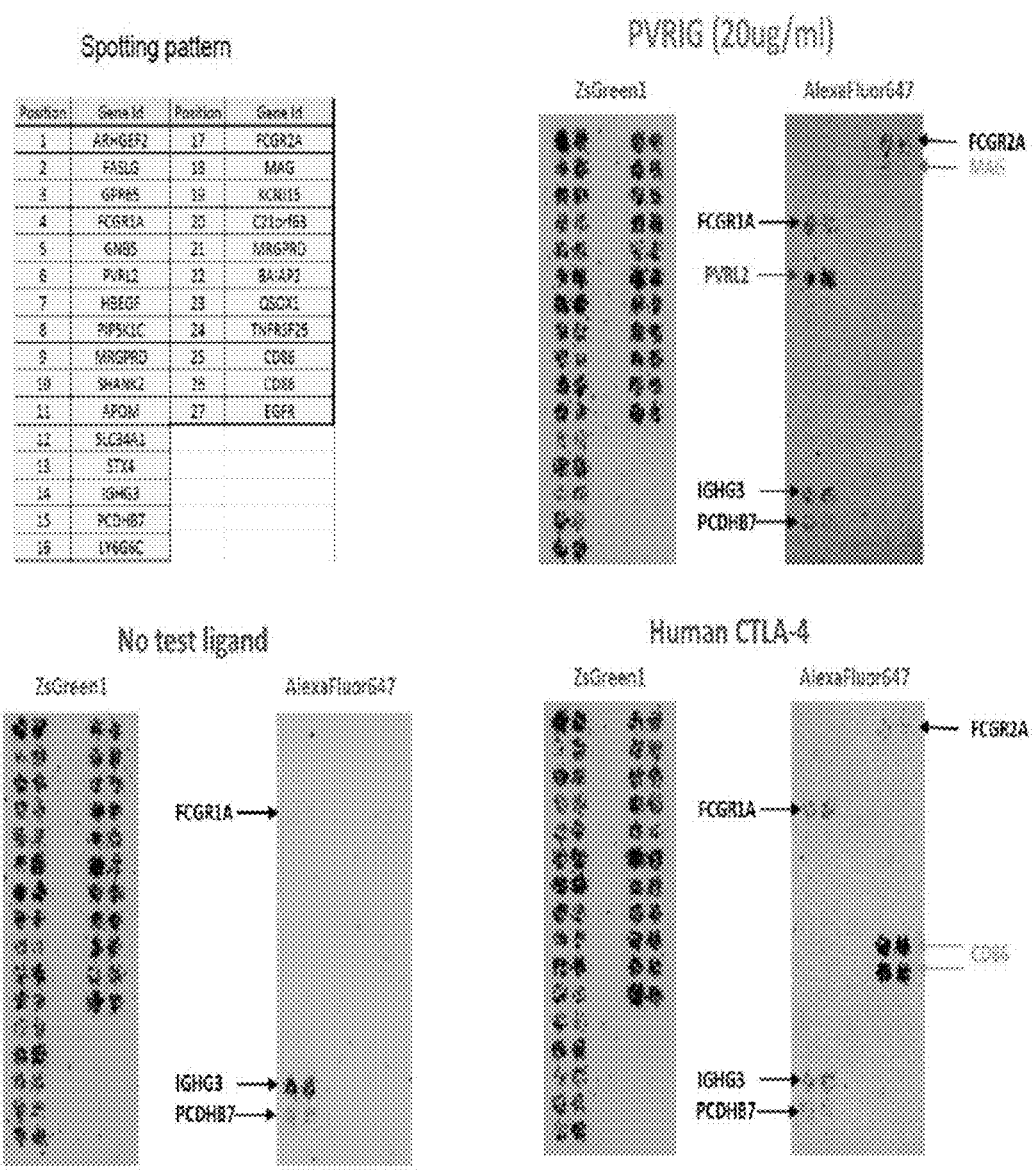
FIG. 14 presents representative images from the Confirmation/Specificity screen. All hits from the Primary screen, and EGFR-expressing vector (negative control), were re-arrayed/expressed in duplicate and probed with PVRIG at 20 µg/ml. A specific hit with strong intensity is shown in green (PVRL2). Non-specific hits are shown in black. Another weak hit (MAG) was later shown to bind also other ligands, thus suggesting that it is not specific.

A single specific hit, PVRL2, with strong intensity, was identified (FIG. 14). Another weak hit, MAG, was later shown to bind also other fusion proteins tested (data not shown), thus suggesting that it is not specific. These results are consistent with the recently published abstract https://www.yumpu.com/en/document/view/7263720/sunday-december-4-late-abstracts-1-molecular-biology-of-the-/133 by G. Quinones in New Technologies & Frontiers. PVRL2 is known to play a role as a ligand for TIGIT and DNAM1, which are both modulators of T cell and NK cell activation. TIGIT has been recently reported to be a key player in the inhibition of the immune response directed against tumor cells (Noa Stanietsky, journal of immunology, vol. 106 no. 42, 17858-17863; Robert J Johnston, Cancer cell, Volume 26, Issue 6, p 923-937, 8 Dec. 2014). Results presented in Example 5, showing interaction of PVRIG with the same counterpart as TIGIT, suggests an involvement of PVRIG in an important regulatory pathway that regulates cancer immune surveillance and thus positions PVRIG as a potential target for cancer treatment.

Additional Validation Study 2

Materials and Methods

Materials

Fc Fusion Proteins, his-Tagged Proteins and Control Ig:

The Fc fusion protein PVRIG-Fc M:M was used for binding studies. Mouse IgG2a was used as isotype control. Other commercial mouse proteins used in the study were PVRL2-his (R&D, 3869-N2), and PVRL2-his (Sino Biological, 50318-MO8H).

Cells:

HEK293 over-expressing (OX) mouse PVRIG and PVRIG-FLAG were generated (RC-287 and RC-286, respectively) and binding of PVRL2 to these cells was compared to HEK293 cells expressing empty vector (EV) (RC-83). HEK293 OX mouse PVRL2 splice variants 1 and 2 (sv1 and sv2) were generated (RC-334 and RC-335, respectively) and binding of PVRIG to these cells was compared to HEK293 cells expressing EV. B16-F10 cells (CL-161, mouse skin melanoma cells endogenously expressing mPVRL2) were also used to study the interaction between PVRIG and PVRL2.

Antibodies:

Anti-mouse PVRL2-PE Ab (R&D, FAB3869P, 25 µg/ml, 1:100) was used for detection of PVRL2. Rat IgG2A-PE (R&D, IC006P, 25 µg/ml, 1:100) was used as isotype control. Anti-mouse-PE (Jackson Immunoresearch, 115-115-206, 0.5 mg/ml, 1:200) and anti-his Ab (Abcam, ab72467, 0.1 mg/ml, 1:300) were used to detect binding of recombinant proteins. Anti-DYKDDDDK Tag ("DYKDDDDK" disclosed as SEQ ID NO: 6) (anti-FLAG) Ab (BioLegend, 637302, 0.5 mg/ml, 1:300) was used for detection of PVRIG expression on HEK293 OX mouse PVRIG-FLAG. For PVRIG labeling, Alexa Fluor® 647 Antibody Labeling Kit (Molecular Probes, A-20186) was used according to manufacturer's protocol. For biotinylation of PVRIG, DSB-X™ Biotin Protein Labeling Kit (Molecular Probes, D-20655) was used according to manufacturer's protocol. Biotinylated PVRIG was detected by streptavidin-PE (SA-PE) (Jackson Immunoresearch, 016-110-084, 0.5 mg/ml, 1:300).

Methods

FACS Analysis of Mouse PVRIG-Fc Binding to Stable HEK293 Cells Over-Expressing (OX) Mouse PVRL2 or to B16-F10 Cells:

HEK293 cells OX PVRL2 (sv1 or sv2) or B16-F10 cells were suspended to $10^6$ cells/ml in PBS. For each 1 ml of cells, 1 µl of viability stain stock solution (BD Horizon Fixable Viability Stain 450, cat. 562247, BD Bioscience) was added. Cells were incubated for 10 min protected from light at room temperature. The cells were then washed twice with PBS and suspended to $3 \times 10^6$ cells/ml in the presence of 1:50 human TruStain FcX™ (BioLegend 422302) in FACS buffer (PBS supplemented with 2% FBS and 0.5 mM EDTA) at room temperature for 15 min for blocking of Fcγ-receptors. Without washing, $1 \times 10^5$ cells/well were then plated in 96-well V-shaped plates (Costar #3357). Expression of PVRL2 was examined by anti-PVRL2 antibody (see above). Binding of PVRIG-Fc to cells was examined with various batches (see above), generally at 60 µg/ml or with several concentrations. Cells were incubated with antibodies or PVRIG-Fc for 40 min at room temperature, then washed once. Secondary antibody (anti-mouse-PE) was added for 15 min at room temperature, cells were washed twice and were taken for analysis by MACSQuant® FACS analyzers (Miltenyi Biotec), followed by data analysis using Flow-Jo 10 software.

FACS Analysis of Mouse PVRL2-his Binding to Stable HEK293 Cells OX Mouse PVRIG:

PVRIG levels were examined with anti-FLAG antibody. PVRL2-his binding was monitored by anti-his antibody. FACS analysis was performed as described above.

Biophysical SPR Analysis of Mouse PVRIG/PVRL2 Interaction by Biacore:

The interaction between mouse PVRIG and PVRL2 was analyzed in a Biacore T100 SPR biomolecular interaction analyzer at Bar-Ilan University. Proteins were diluted to 100 nM in acetate buffer pH 4.0, and were covalently coupled to a unique flow cell of a CM5 Series S Biacore chip using standard amine coupling chemistry. Surfaces were activated with EDC-NHS, and later blocked by injection of 1M ethanolamine (pH 8.5). Running buffer was 10 mM Hepes pH 7.3, 150 mM NaCl, 3 mM EDTA and 0.05% Tween-20 (HBS-EP+). Final immobilization levels were ~1000 RU. Proteins used as analytes were diluted to 2500 nM, 500 nM and 100 nM. In each run one tube contained running buffer only for reference. After each run a regeneration step with 4M MgCl2 for 30 sec at 20 µl/sec was performed.

Results

Binding of Mouse PVRIG to HEK293 Cells OX PVRL2 sv1:

In order to validate the interaction between mouse PVRIG and mouse PVRL2 we first tested the binding of PVRIG-Fc to cells over-expressing (OX) PVRL2. The level of PVRL2 expression on HEK293 OX PVRL2 sv1 was determined using specific anti-mouse PVRL2 antibodies. Mouse PVRL2 expression was 10-fold higher compared to HEK293 cells expressing empty vector (data not shown). Four batches of PVRIG-Fc were examined for binding to PVRL2 OX cells. All PVRIG-Fc batches showed 6-11-fold binding to cells OX PVRL2 compared to empty vector cells (data not shown). Binding of PVRIG-Fc to PVRL2 OX cells was also examined using biotinylated and fluorescently labelled (Alexa Fluor 647) PVRIG proteins. While the biotinylated proteins displayed slightly stronger binding to PVRL2 OX cells compared to untagged PVRIG-Fc (data not shown), fluorescently labelled PVRIG demonstrated much lower binding (data not shown). These results show that PVLR2 is detected on the membrane of HEK293 cells OC PVRL2; binding of mouse PVRIG-Fc to PVRL2 OX cells is detected by anti-mouse IgG2A antibodies; binding of biotinylated mouse PVRIG-Fc to PVRL2 OX cells is detected by streptavidin-PE, and binding of Alexa Fluor 647-labeled PVRIG-Fc to PVRL2 OX cells.

Binding of Mouse PVRL2 to HEK293 Cells OX PVRIG:

To further validate the interaction between mouse PVRIG and mouse PVRL2 we tested the binding of PVRL2 to cells OX PVRIG with or without a FLAG-tag. Membrane expression of mouse PVRIG on HEK293 cells OX PVRIG with a FLAG-tag was confirmed using an anti-FLAG antibody (data not shown). As expected, HEK293 cells OX PVRIG without a FLAG-tag showed no expression using an anti-FLAG antibody. Using anti-PVRIG supernatants (Aldeveron), these cells demonstrated lower expression of PVRIG compared to cells OX PVRIG with a FLAG-tag. Commercial mouse PVRL2 recombinant protein was available only as a His-tagged protein. Therefore, extensive calibrations were required to obtain an appropriate anti-His antibody and conditions for detection. His-tagged PVRL2, from two different sources, were tested for binding to PVRIG OX cells at 60 µg/ml and demonstrated 2-fold (data not shown) and 3-4 fold (data not shown) binding compared to HEK293 cells expressing empty vector. That is, his-tagged mouse PVLR2 binds HEK293 OX mouse PVRIG, and mouse PVRIG is expressed on membranes of HEK293 cells OX PVRIG.

Study of Mouse PVRIG and Mouse PVRL2 Interaction Using SPR-Biacore:

In order to assess the interaction between mouse PVRIG-Fc and mouse His-tagged PVRL2, both proteins were immobilized to a Biacore chip. Following immobilization, both proteins, as well as PVRIG-Fc (data not shown) were run as analytes at three concentrations: 2500, 500 and 100 nM (PVRIG batch #480 and PVRL2 were run twice as analytes). Interaction between the two proteins was detected in both directions and with both batches of PVRIG (data not shown). Due to complex kinetics, an exact KD could not be determined from the Biacore results.

Dose Response Binding of Mouse PVRIG to HEK293 Cells OX PVRL2 sv2 and B16-F10 Cells:

As shown above, mouse PVRL2 binding to mouse PVRIG OX cells was relatively low. In order to establish a method for screening anti-mouse PVRIG antibodies capable of blocking the interaction between mouse PVRIG and mouse PVRL2, the binding of PVRIG-Fc to PVRL2 OX cells was selected. First, a dose response binding curve of mouse IgG2A and mouse PVRIG-Fc to cells OX mouse PVRL2 was generated and compared to cells expressing empty vector (EV). The dose response was performed in two-fold serial dilutions (1:2) from 50 µg/ml to 0.1 µg/ml. While no difference in mouse IgG2A binding was observed (data not shown), PVRIG-Fc demonstrated saturation of binding at 12.5 µg/ml and reduced binding in correlation with the decrease in protein concentration (data not shown). Similar results were obtained also with PVRIG-Fc (data not shown). These results suggest that this binding assay can be considered for screening of blocking antibodies.

In order to consider also an endogenous system for screening of anti-mouse PVRIG antibodies, the expression of PVRL2 on B16-F10 cells was assessed using an anti-PVRL2 antibody. Results show that PVRL2 is highly expressed on B16-F10 cells (data not shown). Therefore, a similar dose response binding curve was produced also for binding of mouse IgG2A and mouse PVRIG-Fc to B16-F10 cells. Similarly to the results obtained with HEK293 cells OX PVRL2, mouse PVRIG-Fc demonstrated dose response binding to B16-F10 cells reaching saturation at 12.5 µg/ml, while no change in binding of mouse IgG2A was detected (data not shown).

Discussion and Conclusions:

Human PVRIG interaction with human PVRL2 was identified using Cell Microarray Technology at Retrogenix. To validate this interaction also in mouse, several approaches were taken. Among them the use of PVRIG or PVRL2 OX cells, and biophysical measurements using SPR-Biacore. All approaches indicated that mouse PVRIG interacts with mouse PVRL2. However, the binding of mouse PVRL2 to cells OX PVRIG was relatively low compared to the binding of PVRIG to cells OX PVRL2. The reason for this could be the fact that commercial PVRL2 is available only as a monomer His-tagged protein and not as an Fc-fused protein (as for PVRIG). To this end, a custom Fc-fused mouse PVRL2 was produced at GenScript. However, from preliminary data, only a minor increase in binding was observed with this protein (~5-fold compared to 2-3 fold with the PVRL2-his). Therefore, some other factors might influence this relatively low binding.

Due to the low PVRL2 binding to cells OX PVRIG, it was decided to establish an anti-PVRIG antibody blocking assay using PVRIG-Fc binding to cells OX PVRL2. According to the observed dose response curves we suggested three working concentrations: 0.1, 0.2 and 0.4 µg/ml. Following similar results obtained with binding of PVRIG to PVRL2 endogenously expressing B16-F10 cells, we suggested to perform the antibody blocking assay also on these cells at the following concentrations: 0.2, 0.4, 0.8 µg/ml.

PVRIG is a presumed receptor, therefore, preferably the antibody blocking assay should be performed with PVRL2 as a soluble protein and PVRIG expressed on the cells. Thus, it should be considered to examine anti-mouse PVRIG antibodies that demonstrate blocking activity in the current format also in this system.

Additional Validation Study 3

The objective of this study is to confirm the binding partners of PVRIG, a novel immuno-oncology target. Preliminary studies indicate that one of these ligands is PVRL2. In this study, binding of the recombinant PVRIG protein to several potential ligands in the PVRIG axis has been investigated by ELISA.

Protocols

List of reagents: Current literature on the PVRIG proteins suggests that there are three potential ligands: PVR (CD155), PVRL2 (CD112), and PVRL3 (CD113). To investigate their ability to bind the PVRIG receptor, these three ligands were sourced commercially, as follows: PVR and PVRL3 from Sino Biologicals Inc. and PVRL2 from R&D Systems and Sino Biologicals Inc. The human PVRIG recombinant protein was generated at Compugen as the PVRIG extra-cellular domain (ECD) fused to a human IgG1 Fc domain (PVRIGHH).

ELISA to determine receptor-ligand interaction: Commercially sourced His-tagged ligands, PVR, PVRL2, and PVRL3, were coated on the wells of a high binding EIA/RIA plate (Costar 9018) overnight at 4° C. An irrelevant His-tagged protein was included as a negative control. Coated plate wells were rinsed twice with PBS and incubated with 300 µL blocking buffer (5% skim milk powder in PBS pH 7.4) at room temperature (RT) for 1 hr. Blocking buffer was removed and plates were rinsed twice more with PBS. Plate-bound ligands were incubated with varying concentrations of PVRIGHH in solution (linear range of 0.1 µg/mL to 4 µg/mL in a 50 µL/well volume) at RT for 1 hr. Plates were washed three times with PBS-T (PBS 7.4, 0.05% Tween20), then three times with PBS and 50 µL/well of a HRP-conjugated secondary antibody was added (Human IgG Fc domain specific, Jackson ImmunoResearch). This was incubated at RT for 1 hr and plates were washed again. ELISA signals were developed in all wells by adding 50 µL of Sureblue TMB substrate (KPL Inc) and incubating for 5-20 mins. The HRP reaction was stopped by adding 50 µL 2N H2SO4 (VWR) and absorbance signals at 450 nm were read on a SpectraMax (Molecular Devices) or EnVision (PerkinElmer) spectrophotometer. The data were exported to Excel (Microsoft) and plotted in GraphPad Prism (GraphPad Software, Inc.).

Results: PVRIG preferably binds to PVRL2: The human PVRIG Fc-fusion protein was assayed for binding to PVR, PVRL2 and PVRL3, which were immobilized on an EIA/RIA plate. Varying concentrations of the receptor PVRIG in solution phase were incubated with the immobilized ligand. The data clearly show dose-dependent binding of PVRIGHH to PVRL2, but no binding to ligands PVR, PVRL3 or the negative control protein (data not shown). The ELISA A450 signal was plotted as a function of the receptor concentration using a one-site binding equation, revealing an equilibrium binding constant (KD) of 13±1 nM.

Summary and Conclusions:

PVRIG is a novel immuno-oncology target for which the biology is not fully understood. In an effort to shed more light on this biology, we examined its binding to several potential ligands. PVRL2 was clearly identified as the binding partner of PVRIG. Quantitative analysis suggests that this interaction is very strong, with a KD of 13±1 nM. Our results also suggest that human PVRIG either does not bind the human PVR and PVRL3, or the binding is too weak to detect by ELISA.

Additional Validation Study 4:

In this example, PVRIG expression on PBMC cell subsets was evaluated pre and post allo-activation. Following allo-activation the expression of PVRIG was upregulated on CD4+ T cells as well as on CD8+ T cells and double negative gamma delta T cells. This upregulation was observed in PBMCs of one out of two donors tested (see FIGS. 52A-52B).

Example 6 Surface Plasmon Resonance Studies of PVR, PVRL2, and PVRL3 Binding to PVRIG, DNAM, and TIGIT Materials and Methods All experiments were performed using a ProteOn XPR 36 instrument at 22° C.

Step 1:

A high density goat anti-human fc polyclonal antibody surface (Invitrogen H10500) was prepared over all six lanes of a GLC chip using a ProteOn XPR 36 biosensor. The activation step for the anti-human fc surface occurred in the horizontal flow direction while the immobilization step for the high density pAb occurred in the vertical flow direction. The blocking step occurred in both the vertical and horizontal positions so that the horizontal "interspots" could be used as reference surfaces. An average of ~4400 RU of goat anti-human pAb was immobilized on each lane.

Step 2:

For each cycle, three different lots of human PVRIG fusion protein (human fc, GenScript lots 451, 448, 125), human DNAM-1 fusion protein (human fc, R&D Systems), human TIGIT fusion protein (human fc, R&D Systems), and a control human IgG (Synagis) were each captured over a different vertical lane for two minutes at a concentration of 2 µg/mL. PVR, two lots of PVRL2, and PVRL3 were each injected in the horizontal flow direction at six different concentrations over all six captured ligands at different ligand capture cycles. The injections were two minutes followed by 10 minutes of dissociation at a flow rate of 50 µL/min. The PVR concentration range was 1.4 nM-332 nM in a 3-fold dilution series, both lots of PVRL2 were injected at a concentration range of 1.3 nM-322 nM in a 3-fold dilution series, and PVRL3 was injected at a concentration range of 1.4 nM-334 nM in a 3-fold dilution series. All protein reagents were prepared in running buffer which was degassed PBS buffer with 0.05% Tween 20 and 0.01% BSA added. The anti-human fc capture surfaces were regenerated with two 30-second pulses of 146 mM phosphoric acid after each cycle.

Step 3:

Sensorgram data of the analytes binding to each captured ligand were processed and double-referenced using ProteOn Manager version 3.1.0.6 making use of interspot referencing and a pre-blank injection identical to the analyte injections.

Results a) PVR:

Binds weakly to captured DNAM-1 and TIGIT and shows no binding to all three lots of PVRIG and the control IgG. Not enough information was generated to estimate the $K_D$ of the PVR interactions with DNAM-1 and TIGIT (data not shown).

b) PVRL2:

Both lots of PVRL2 showed binding to all three lots of PVRIG and to DNAM-1 but minimal or no binding to TIGIT and no binding to the control IgG.

Sensorgrams showed complex kinetics, therefore binding constants could not be estimated (data not shown).

c) PVRL3:

Showed minimal binding to TIGIT and did not bind the other proteins (data not shown).

Example 7: In-Vitro Immunomodulatory Activities of PVRIG ECD-IG on Mouse T Cells In these experiments the immunomodulatory activities of the recombinant fused protein PVRIG-ECD-Ig was investigated on mouse T cell activation. The effect of PVRIG-ECD-Ig on activation of mouse CD4 T cells was investigated using a number of in-vitro T cell activation readouts: cell activation markers, cytokine secretion and proliferation.

In order to evaluate the activity of pvrig protein on t cell activation, recombinant protein was produced comprising the mouse extracellular domain (ECD) of the mouse PVRIG fused to the Fc of mouse IgG2a (designated PVRIG-ECD IG M:M) (SEQ ID NO:29). The effect of the Fc fused protein co-immobilized with anti-CD3 on mouse CD4 T cell functions, as manifested by activation markers and cytokines secretion was investigated.

Materials and Methods

Fc fusion protein and control Ig:Fc fusion protein, PVRIG-ECD-Ig (batch #198) was tested. Mouse IgG2a (clone MOPC-173; Biolegend or C1.18.4; BioXcell) was used as isotype control.

Mouse CD4 T Cells Isolation:

Untouched CD4+CD25− T cells were isolated from pools of spleens of BALB/C mice using a T cell isolation Kit (Miltenyi Cat#130-093-227) according to the manufacturer's instructions. The purity obtained was >90%.

Activation of Mouse CD4 T Cells:

Anti-mouse CD3-c mAb (clone 145-2C11; BD Biosciences) at 2 µg/ml together with PVRIG-ECD-Ig protein or control Ig at various concentrations (1, 3 or 10 µg/ml), were co-immobilized for 3 hr at 37° C., on 96-well flat bottom tissue culture plates (Sigma, Cat. #Z707910). Control Ig was added to each well in order to complete a total protein concentration of 12 µg/ml per well. Wells were washed 3 times with PBS and plated with $1\times10^5$ purified CD4+ CD25-T cells per well and kept in a humidified, 5% CO2, 37° C. incubator. In some experiments, soluble anti-CD28 (clone: 37.51; eBioscience; 1 µg/ml) was added. Culture supernatants were collected at the indicated times post stimulation and analyzed for mouse IFNγ or IL-2 secretion by ELISA kits (R&D Systems). The effect of PVRIG-ECD-Ig protein (see FIG. 103) on the expression of the activation marker CD69 on mouse CD4+ T cells was analyzed by flow cytometry. Cells were stained 48 h post stimulation with a cocktail of antibodies including PerCP-anti-CD4 (clone G41.5; Biolegend), FITC or PE-anti-CD69 (clone H1.2F3; Biolegend), in the presence of anti-CD16/32 (clone 2.4g2; BD Biosciences) for blocking of Fcγ-receptors. Cells were evaluated using MACSQuant analyzer 9 (Miltenyi) and data analyzed using BD CellQuest or by MACSQuantify™ Software. Data was analyzed using Excel or Prism4 software.

Results and Summary

Figure 15A:
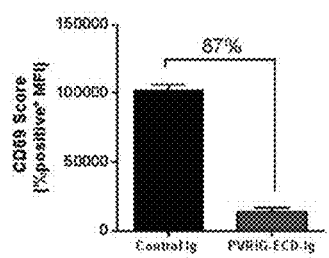
FIGS. 15A-15E presents effect of various PVRIG-ECD-Ig M:M proteins on mouse CD4 T cell activation. Plates were coated with anti-CD3 mAb (2 μg/mL) in the presence of 10 μg/ml PVRIG-ECD Ig (batch #198) or control mIgG2a as described in materials and methods. Wells were plated with 1×10$^5$ CD4+CD25− mouse T cells per well in the presence of 2 μg/ml of soluble anti-CD28. (A) The expression of CD69 was analyzed by flow cytometry at 48 h post-stimulation, representative histograms are shown. Each bar is the mean of duplicate cultures, the error bars indicating the standard deviation. (B-C) Culture supernatants were collected at 48 h post-stimulation and mouse IL-2 and IFNγ levels were analyzed by ELISA. Results are shown as Mean±Standard errors of duplicate samples. (D) Dose response effect of immobilized PVRIG-ECD Ig (FIG. 92BB on surface CD69 (D) and IFNγ secretion (E) is presented. Each bar is the mean of triplicate cultures, the error bars indicating the standard errors.
Figure 15B:
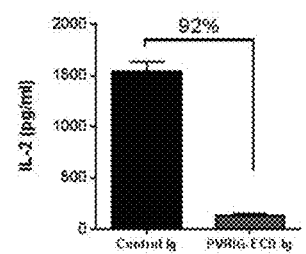
Figure 15C:
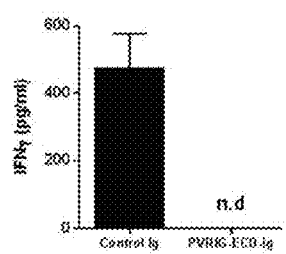
Figure 15D:
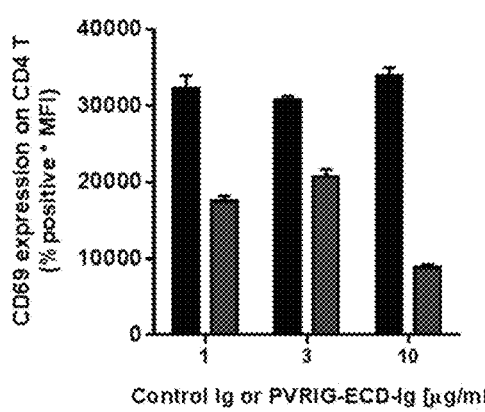
Figure 15E:
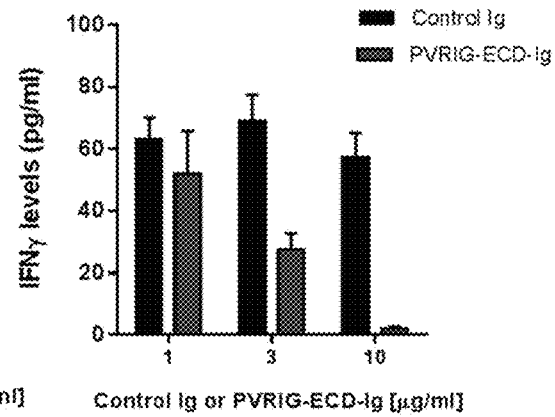

Effect of PVRIG-ECD Ig M:M (See FIG. 103) on Mouse CD4+ T Cells Function:

FIGS. 15A-15E show in-vitro immunomodulatory activities of PVRIG-ECD-Ig (see FIG. 103) on isolated mouse splenic T cells (CD4+, >95% purity) stimulated with microplates co-immobilized with anti-CD3 (2 µg/ml) alone or co-immobilized with control Ig (mIgG2a) or PVRIG-ECD-Ig (see FIG. 103)) (10 µg/ml) in the presence of soluble anti-CD28 (1 µg/ml). PVRIG-ECD-Ig (see FIG. 103) suppressed mouse CD4 T cell activation in a dose dependent manner, as manifested by reduced CD69 up-regulation (FIGS. 15A, D), and reduction in TCR-induced cytokines (IL-2 and IFNγ) secretion (FIGS. 15B-C, E). The magnitude of the inhibitory effect of PVRIG-ECD-Ig ((see FIG. 103)) was in the range of 30-100%. Inhibitory effect of PVRIG-ECD-Ig ((see FIG. 103)) on IFNγ secretion was observed in concentrations as low as 3 µg/ml (~60% inhibition vs. control Ig).

PVRIG-ECD-Ig (see FIG. 103) inhibits T cell activation in a concentration-dependent manner when the Fc fusion protein is co-immobilized with anti-CD3 on plates. Maximal inhibitory effect was observed at 10 µg/ml of PVRIG-ECD-Ig (see FIG. 103).

The results demonstrate the inhibitory effect of PVRIG-ECD-Ig on mouse T cells activation, manifested by reduced cytokine secretion, and suppression of activation marker CD69 upregulation. This inhibition of T cell activation, supports the therapeutic potential of immunoinhibitory PVRIG proteins (PVRIG polypeptides and fusion proteins) according to the present invention in treating T cell-driven autoimmune diseases, such as rheumatoid arthritis, multiple sclerosis, psoriasis and inflammatory bowel disease, as well as for other immune related diseases and/or for reducing the undesirable immune activation that follows gene therapy. In addition, these results also support the therapeutic potential of immunostimulatory PVRIG proteins (PVRIG polypeptides and fusion proteins) that reduce the inhibitory activity of PVRIG for treating conditions which should benefit from enhanced immune responses, in particular enhanced CTL immunity and proinflammatory cytokines such as cancer, infectious diseases, particularly chronic infections and sepsis wherein T cell-mediated depletion of diseased cells is therapeutically advantageous.

Example 8: In-Vitro Immunomodulatory Activities of PVRIG on Human Cytotoxic T Cells (CTLs)

The experiments described in this example evaluated the effect of ectopic expression of human PVRIG on different melanoma cell lines on their ability to activate CTLs (cytotoxic T lymphocytes) and serve as targets for killing by these cells.

Materials & Methods:

Three human melanoma cell lines which present the MART-1 antigen in HLA-A2 context (SK-MEL-23, Mel-624 and Mel-624.38) were used as targets for CTLs. Mel-888 which does not express HLA-A2, served as a negative control.

Ectopic Expression of Human PVRIG on Cytotoxic T Lymphocytes (CTLs):

In order to express human PVRIG in peripheral blood leukocyte (PBL) cultures, the cDNA encoding for PVRIG was amplified using specific primers and cloned into an MSCV-based retroviral vector (pMSGV1) or in tripartite vectors: the CD8-dependent F4 TCR α- and β-chains were linked with a P2A sequence and cloned into pMSGV1 vector, either followed by an internal ribosome entry site (IRES) and PVRIG. The retroviral vector encoding for NGFR1, as negative control or in tripartite vectors: the CD8-dependent F4 TCR α- and β-chains were linked with a P2A sequence and cloned into pMSGV1 vector, either followed by an internal ribosome entry site (IRES) and NGFR. Verification of the cloning was done first using restriction enzyme digestion and subsequently by sequencing. Upon sequence confirmation, large amounts of the retroviral vector (Maxi-prep) were produced for subsequent use.

Peripheral blood leukocytes of healthy human donors were transduced with the retroviral constructs encoding PVRIG or with the retroviral vectors encoding for NGFR1 or an empty vector, as negative control. Transduction was carried out using a retronectin-based protocol; briefly, retroviral supernatant was produced in 293GP cells (a retroviral packaging cell line) following transfection with the retroviral vector and an amphotropic envelop gene (VSV-G). The retroviral supernatant was plated on retronectin-coated plates prior to the transduction to enable the binding of virions to the plate, and the PBLs were added to the plate for 6 hours. After that, the cells were replenished in a new culture vessel. Transduction efficiency and expression of the protein was determined by staining the transduced PBLs with commercial PVRIG specific rabbit polyclonal antibody or with commercial anti-NGFR (Cat. No 345108; BioLegend). Rabbit IgG (Sigma Cat. No. 15006) was used as isotype control, and as secondary antibody we used APC-conjugated anti-rabbit IgG (Jackson, Cat. No. 711-136-152).

Ectopic Expression of the F4 T Cell Receptor on Cytotoxic T Lymphocytes (CTLs):

In order to obtain effector lymphocytes that express the MART-1-specific F4 TCR, specifically recognizing MART-126-35-/HLA-A2 peptide-MHC complex, freshly isolated human PBLs previously transduced to express either with PVRIG, NGFR or an empty vector were stimulated with PHA and cultured for 5-10 days, and subsequently transduced with in vitro-transcribed mRNA encoding both α and β chains from the MART-1-specific F4 TCR. The transduced lymphocytes were cultured in lymphocyte medium (Bio target medium, fetal bovine serum (10%), L Glutamine Penicillin/Streptomicyn (100 units/ml), IL-2 300 IU), replenished every 2-3 days. F4 TCR expression levels were verified by FACS staining using a specific monoclonal antibody that recognizes the extra-cellular domain of the beta-chain from the transduced specific TCR. (TCR-Vb12-PE, (Cat. No IM2291; Beckman Coulter).

Cytokine Secretion from PVRIG, NGFR or an Empty Vector and F4-TCR Transduced Lymphocytes Upon Co-Culture with Melanoma Cells:

PBLs expressing PVRIG or NGFR along with F4-TCR were co-cultured with un-manipulated melanoma cells. $10^5$ transduced PBLs were co-cultured with $10^5$ melanoma target cells for 16 hours. In order to assess the response of the effector CD8 T cells to the different tumor cell lines, cytokine secretion (IFNγ, IL-2 and TNF-α) was measured by ELISA in culture supernatants (IFNγ (Cat. No DY285E), IL-2 (Cat. No DY202E), TNF-α (Cat. No DY210E) R&D SYSTEMS), diluted to be in the linear range of the ELISA assay.

Cell Mediated Cytotoxicity Assay:

This assay was performed in order to assess target cell killing upon co-culture. PVRIG and F4 were expressed in PBLs using a bi-cystronic vector and co-cultured with CFSE labeled melanoma Target cells (labeled with 2 mM CFSE (eBioscience) for 6 min), at 37° C. for 18 hr, at E:T ratio of 3:1. Cells were collected after 18 hr and and 1 mM propidium iodide (Sigma-Aldrich) was added for assigning the ratio of cell death. Samples were run on a CyAn-ADP flow cytometer (Beckman Coulter).

Results:

General Design of the Experimental System:

In the experimental system described herein, PVRIG is over expressed on human PBLs which are next manipulated to express the MART1-specific and HLA-A2 restricted F4 TCR. Over expressing cells are then co-cultured with HLA-A2 positive (name them) and HLA-A2 negative (names) melanoma cell lines (reference). The F4 TCR was recently used in clinical trials in terminally-ill melanoma patients to specifically confer tumor recognition by autologous lymphocytes from peripheral blood by using a retrovirus encoding the TCR (Morgan et al, 2006 Science, 314:126-129). The effect of PVRIG expression on antigen-specific activation of CD8 T cells by co-culture with cognate melanoma cells was assessed by cytokine secretion.

Over Expression of PVRIG on Human PBLs—Experiment 1:

Human PBLs were transduced with a retroviral vector encoding the PVRIG or an empty vector as negative control, as described in Materials & Methods. The levels of PVRIG were assessed by flow cytometry at 48 hrs after transduction, and compared to cells transduced with an empty vector. The percentage of the transgene-expressing cells was 62.4% as shown in FIG. 16.

Over Expression of PVRIG on Human PBLs—Experiment 2:

Human PBLs were transduced with a retroviral vector encoding the PVRIG or NGFR or an empty vector as negative controls, as described in Materials & Methods. The levels of PVRIG were assessed by flow cytometry at 48 hrs after transduction, and compared to cells transduced with an empty vector. The percentage of the PVRIG-expressing cells was in the range of 20%. The expression of NGFR was of 63% as shown in FIG. 17. A few additional attempts to over express PVRIG on PBLs were un-successful. One possibility is that the difficulty in expressing PVRIG in primary PBLs stems from a basal endogenous expression level in these cells.

Figure 18A:
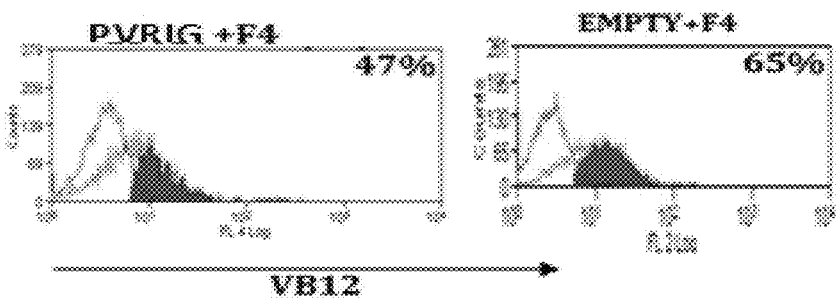
FIGS. 18A-18B presents FACS analysis performed on TCR transduced stimulated PBLs for experiment 1 (FIG. 18A) and in experiment 2 (FIG. 18B) using a specific monoclonal antibody that recognizes the extra-cellular domain of the beta-chain from the transduced specific TCR. The percentage of cells staining positive is provided.
Figure 18B:
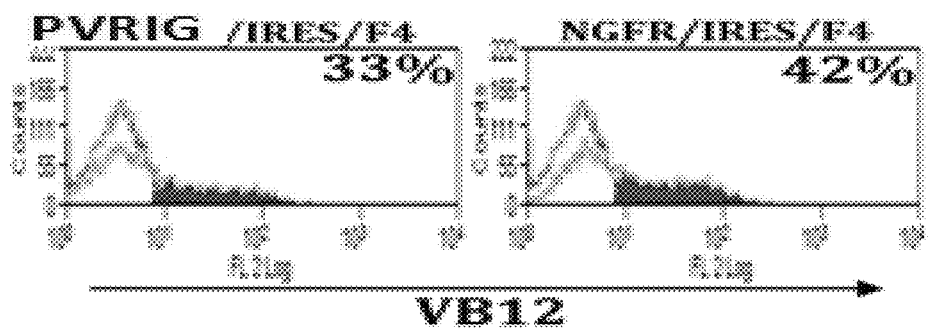

Over Expression of F4 TCR on Human PBLs:

To perform functional assays with human CTLs, we used PBLs engineered to express the F4 TCR, which recognizes HLA-A2+/MART1+ melanoma cells, as described in Materials & Methods. FIG. 18A shows levels of F4 TCR expression obtained upon TCR transduction of leukocytes used in experiment 1, FIG. 18B shows levels of F4 TCR expression obtained upon TCR transduction of leukocytes used in experiment 2.

Figure 19:
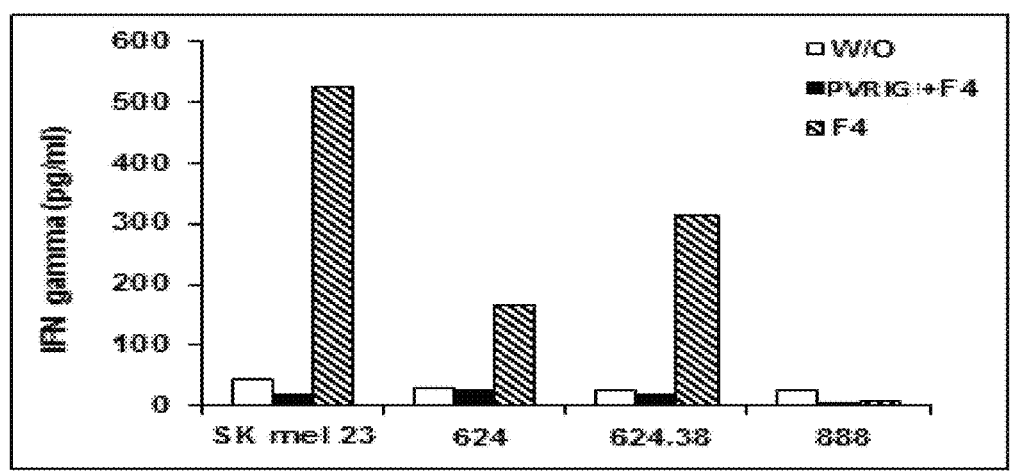
FIG. 19 shows expression of PVRIG on F4 expressing PBLs causes a reduction of IFNγ secretion upon co-culture with SK-MEL23, MEL-624 and MEL-624.38 in comparison to expression of an empty vector.

Effect of PVRIG Expression on IFNγ Secretion—Experiment 1:

PVRIG or Empty-vector and F4-transduced PBLs were co-cultured with melanoma cell lines. The levels of IFNγ secretion were measured at 16-hours of co-culture. As shown in FIG. 19, the magnitude of inhibition of IFNγ secretion due to PVRIG over-expression was more than 90%. Co-culture with the HLA-A2 negative cell line Mel-888 which served as a negative control, caused only a minor activation dependent IFNγ secretion from F4-transduced lymphocytes. PBLs not expressing the F4 TCR (designated W/O) serve as an additional negative control.

Figure 20A:
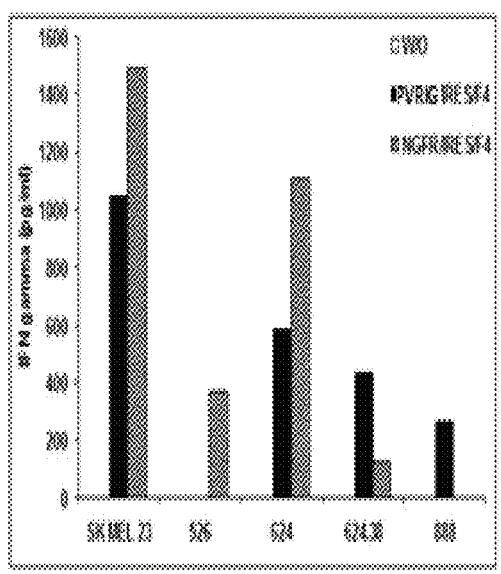
FIGS. 20A-20B shows expression of PVRIG and F4 in PBLs by co-transduction (FIG. 20A) does not affect IFNγ secretion in co-culture with melanoma cell lines. Expression of PVRIG and F4 in PBLs using a bi-cystronic vector (FIG. 20B) causes a reduction of IFNγ secretion upon co-culture with SK-MEL23, MEL-624 and MEL-624.38 in comparison to expression of an empty vector.
Figure 20B:
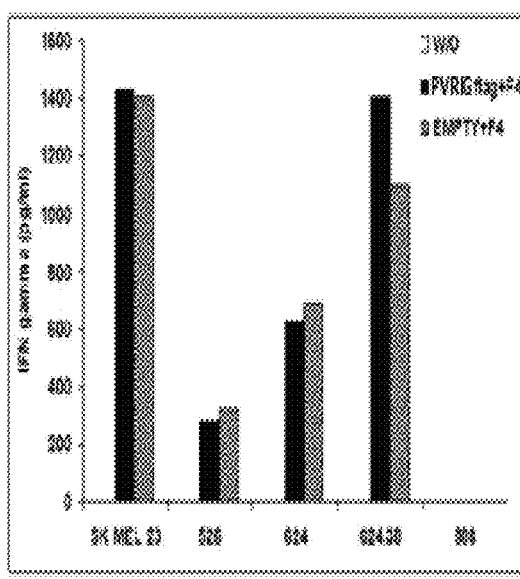

Effect of PVRIG Expression on IFNγ Secretion—Experiment 2:

PVRIG, NGFR or Empty-vector and F4 were transduced into PBLs in co-transduction (FIG. 20A) or using a bi-cystronic vector (FIG. 20B). Transduced PBLs were co-cultured with melanoma cell lines. The levels of IFNγ secretion were measured at 16-hours of co-culture. As shown in FIG. 20A, the magnitude of inhibition of cytokine secretion due to PVRIG over-expression was in the range of 30%. Co-culture with the HLA-A2 negative cell line Mel-888 which served as a negative control, caused only a minor activation dependent IFNγ secretion from F4-transduced lymphocytes. PBLs not expressing the F4 TCR (designated W/O) serve as an additional negative control. As shown in FIG. 20B, when PVRIG is co-transduced with the F4 TCR, no inhibition of IFNγ was observed.

Figure 21:
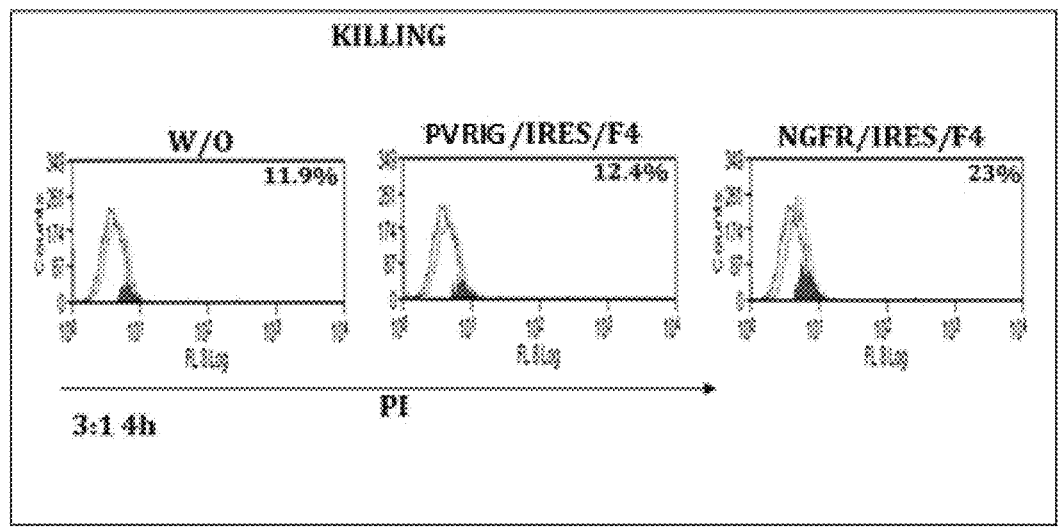
FIG. 21 shows expression of PVRIG and F4 in PBLs using a bi-cystronic vector causes a reduction in T cell mediated cytotoxicity upon co-culture with melanoma cell lines.

Effect of PVRIG on CTL Mediated Killing Activity—Experiment 2:

PVRIG or NGFR and F4 were transduced to PBLs using a bi-cystronic vector and co-cultured with CFSE labeled melanoma cell lines. As shown in FIG. 21, the percentage of propidium Iodide positive events (reflecting intensity of killing activity) was decreased by ~50% by the expression of PVRIG relative to negative control NGFR transduced cells. Killing activity of PVRIG expressing cells is similar to that of co-culture between melanoma and PBLs not expressing the F4 TCR (designated W/O).

Summary:

Without wishing to be limited by a single hypothesis, the results presented herein indicate that overexpression on primary lymphocytes results in reduced cytokine secretion by CTLs, suggesting that PVRIG has an inhibitory effect on CTLs.

Example 9: Human Anti-PVRIG Antibodies

The objective of this study was to isolate human antibodies that bind to the PVRIG immuno-oncology target with high affinity and specificity, and block the interaction of PVRIG with its binding partner, PVRL2. This was achieved by panning a human fab fragment phage display library against a recombinant protein comprising the human PVRIG extracellular domain (ECD) fused to the human IgG1 Fc region, and screening the resulting antibodies for their ability to block the PVRIG interaction with PVRL2.

Protocols

Functional QC of Reagents:

The purity of the panning reagent, PVRIG ECD fused to human IgG1 Fc domain (PVRIGHH), was determined by Microfluidics Capillary Electrophoresis using a LabChip System (PerkinElmer). Activity of the panning reagent was validated by its ability to bind its ligand PVRL2.

ELISA to Detect Protein-Protein Interaction:

His-tagged PVRL2 recombinant protein was diluted to 2 μg/mL in phosphate buffered saline (PBS) and 50 μL aliquots were coated on the wells of a high binding EIA/RIA plate (Costar) overnight at 4° C. Coated plate wells were rinsed twice with PBS and incubated with 300 μL blocking buffer (5% skim milk powder in PBS pH 7.4) at room temperature (RT) for 1 hr. Blocking buffer was removed and plates were rinsed twice more with PBS. Plate-bound PVRL2 was incubated with varying concentrations of PVRIGHH in solution (linear range of 0.1 μg/mL to 4 μg/mL in a 50 μL/well volume) at RT for 1 hr. Plates were washed three times with PBS-T (PBS 7.4, 0.05% Tween20), then three times with PBS and 50 μL/well of a HRP-conjugated secondary antibody was added (Human IgG Fc domain specific). This was incubated at RT for 1 hr and plates were washed again. ELISA signals were developed in all wells by adding 50 μL of Sureblue TMB substrate (KPL Inc) and incubating for 5-20 mins. The HRP reaction was stopped by adding 50 μL 2N H2SO4 (VWR) and absorbance signals at 450 nm were read on a SpectraMax (Molecular Devices) or EnVision (PerkinElmer) spectrophotometer.

Preparation of Biotinylated PVRIG:

To facilitate phage panning in solution using streptavidin-coated magnetic beads, PVRIG H:H and an irrelevant human IgG1 Fc isotype control were biotinylated using Lightning-Link® Biotin kit (Innova Biosciences). Biotinylation reactions were performed following the manufacturer's protocol and the biotinylated reagents were stored at 4° C. for further QC and biopanning. The purity and activity of the biotin-labeled proteins was assessed by LabChip and functional ELISA, as described in Section 2.1. In addition, the degree of biotinylation was assessed by ELISA using two approaches: 1) the biotinylated reagents were adsorbed on a high binding EIA/RIA plate and the proteins were detected using HRP-conjugated streptavidin, and 2) the biotinylated proteins were incubated on EIA/RIA plate precoated with streptavidin and the binding was detected using a HRP-conjugated human IgG Fc domain specific secondary antibody.

Phage Panning of Human Antibody Library:

Panning reactions were carried out in solution using streptavidin-coated magnetic beads to capture the biotinylated antigens. Note that all washing and elution steps were conducted using a magnetic rack to capture the beads (Promega). All incubation steps were conducted at room temperature with gentle mixing on a tube rotator (BioExpress). Four panning sub-campaigns were conducted, each with a different combination of antigen concentrations, washes and Fc-binder depletion steps (Table 1).

All the panning sub-campaigns were carried out using the biotinylated PVRIG H:H antigen. For each round of panning, the phage libraries were depleted against 100 pmol of an irrelevant human IgG1 Fc protein in two successive steps. Following depletion, sub-campaigns A and B involved panning against 50 nM of the antigen in each round, under low and high stringency wash conditions, respectively. Sub-campaigns C and D were identical to sub-campaign B, except that in campaign C the library was blocked with 10-fold excess of the irrelevant IgG1 Fc protein in panning rounds 2 and 3. Sub-campaign D differed in that 5 nM antigen was used in round 3.

TABLE 1

Antigen and washing conditions used for phage panning against PVRIG H:H.

| Sub-campaign | Round | Antigen Concentration | Washes | Fc Depletion |
|---|---|---|---|---|
| A | 1 | 50 nM | 3x PBS-T + 3x PBS | 2X 100 pmol |
|   | 2 | 50 nM | 3x PBS-T + 3x PBS | 2X 100 pmol |
|   | 3 | 50 nM | 3x PBS-T + 3x PBS | 2X 100 pmol |
| B | 1 | 50 nM | 3x PBS-T + 3x PBS | 2X 100 pmol |
|   | 2 | 50 nM | 6x PBS-T + 6x PBS | 2X 100 pmol |
|   | 3 | 50 nM | 6x PBS-T + 6x PBS | 2X 100 pmol |
| C | 1 | 50 nM | 3x PBS-T + 3x PBS | 2X 100 pmol |
|   | 2 | 50 nM | 6x PBS-T + 6x PBS | 2X 100 pmol + block with 1 nmol |
|   | 3 | 50 nM | 6x PBS-T + 6x PBS | 2X 100 pmol block with 1 nmol |

TABLE 1-continued

Antigen and washing conditions used for phage panning against PVRIG H:H.

| Sub-campaign | Round | Antigen Concentration | Washes | Fc Depletion |
|---|---|---|---|---|
| D | 1 | 50 nM | 3x PBS-T + 3x PBS | 2X 100 pmol |
|   | 2 | 50 nM | 6x PBS-T + 6x PBS | 2X 100 pmol |
|   | 3 | 5 nM | 6x PBS-T + 6x PBS | 2X 100 pmol |

2.4. Preparation of phage library for panning: All phage panning experiments used the XOMA031 human fab antibody phage display library (XOMA Corporation, Berkeley, Calif.). Sufficient phage for a 50-fold over-representation of the library were blocked by mixing 1:1 with 10% skim milk powder in PBS (final skim milk concentration 5%) and incubating for 1 hr.

2.4.1. Antigen coupling to streptavidin beads: For each sub-campaign, three 100 µL aliquots of Dynal streptavidin-coated magnetic beads (Life Technologies) were blocked by suspension in 1 mL of blocking buffer (5% skim milk powder in PBS) and incubated for 30 mins. One blocked bead aliquot was mixed with 100 pmols of biotinylated PVRIG H:H. The other two aliquots were mixed with 100 pmols of the irrelevant antigen for depletion of Fc-only binders. Biotin-labeled antigens were coupled to the beads for 30 mins at RT. Bead suspensions were washed twice with PBS to remove free antigen and re-suspended in 100 µL blocking buffer.

2.4.2. Depletion of human IgG1 Fc and streptavidin bead binders from the phage library: It was necessary to remove unwanted binders to streptavidin beads and the Fc region of PVRIGHH before phage panning could commence. To achieve this, blocked phage was mixed with one 100 µL aliquot of uncoupled streptavidin beads and incubated for 45 mins. The beads (and presumably unwanted bead and human IgG1 Fc-binders) were discarded. This step was repeated once and depleted phage library supernatants were reserved for panning.

2.5. Phage panning round 1: The blocked and depleted phage library was mixed with biotinylated PVRIG H:H coupled to magnetic beads described above. This suspension was incubated for 1 hr at RT with gentle rotation to allow binding of PVRIG H:H specific phage. Non-specific binders were removed by washing according to the protocol in Table 1. After washing, bound phage were eluted by incubation with 500 µL of 100 mM triethylamine (TEA) (EMD) for 15 mins at RT. The eluate was neutralized by adding 500 µL of 1 M Tris-HCl pH 8.0 (Teknova).

2.5.1. Determination of phage titer: 10 µL of the initial phage library (input titer) or panning eluate (output titer) was serially diluted (10-fold) in PBS. A 90 µL aliquot of each phage dilution was mixed with 500 µL of TG1 E. coli cells grown to an optical density of ~0.5 at 600 nm (OD 600 nm). Phage were allowed to infect the cells by stationary incubation for 30 mins, then shaking incubation (250 rpm) for 30 mins, all at 37° C. A 10 µL aliquot of each infected cell culture was spotted on a 2YT agar plate supplemented with 2% glucose and 100 µg/mL carbenicillin (2YTCG, Teknova). Plates were incubated overnight at 30° C. Colonies growing from each 10 µL spot were counted and used to calculate input and output titers.

2.5.2. Phage rescue: The remaining phage eluate (~1 mL) was mixed with 10 mL of TG1 E. coli cells grown to an OD 600 nm of 0.5. Phage were infected into cells as detailed in section 2.5.1. Infected cells were pelleted by centrifugation at 2500×G, re-suspended in 750 µL 2YT medium (Teknova) and spread on 2YTCG agar plates. These were incubated overnight at 37° C. and the resulting E. coli lawns were scraped and re-suspended in ~20 mL liquid 2YTCG (Teknova). A small aliquot of re-suspended cells was inoculated into 50 mL 2YTCG to achieve an OD 600 nm of 0.05, and then grown at 37° C. with 250 rpm shaking until the OD reached 0.5. The resulting culture was infected with M13K07 helper phage (New England Biolabs) and incubated overnight at 25° C. with shaking to allow phage packaging. The culture supernatant containing rescued phage particles was cleared by centrifugation at 2500×G and 1 mL was carried over for either a) a subsequent round of panning or b) fab binding screens.

Phage panning rounds 2-3: Second and third rounds of panning were conducted as per the steps above, except that the rescued phage supernatant from the previous round was used in place of the phage library. The washing conditions, depletion and the antigen concentrations used are listed in Table 1.

2.6. Binding screens using fabs prepared from periplasmic extracts 2.6.1. Fab expression vectors: The XOMA031 library is based on phagemid constructs that also function as fab expression vectors. These vectors contain fab heavy chain and light chain expression cassettes, a lac promoter to drive expression of the antibody genes, and an ampicillin resistance gene. The antibody chains are appended with N-terminal signal peptides to drive their secretion into the periplasmic space. The C-terminal of the heavy chain carries a truncated gene III protein sequence for incorporation into phage particles. The heavy chain also carries hexa-histidine (SEQ ID NO: 7), c-myc and V5 affinity tags. Transformation of these vectors into E. coli and induction with isopropyl β-D-1-thiogalactopyranoside (IPTG) results in periplasmic expression of soluble fab molecules.

2.6.2. Fab PPE production: Eluted phage pools from panning round 3 were diluted and infected into TG1 E. coli cells (Lucigen) so that single colonies were generated when spread on a 2YTCG agar plate. This resulted in each colony carrying single fab clone. Individual clones were inoculated into 1 mL 2YTCG starter cultures in 96-well deep well blocks (VWR) using a Qpix2 instrument (Molecular Devices). These starter cultures were grown overnight in a Multitron 3 mm incubator (Infors) at 37° C. with 700 rpm shaking. For fab expression, 20 µL of 1 mL starter cultures were transferred into a second set of deep well plates containing 1 mL 2YT with 0.1% glucose and 100 µg/mL ampicillin. Cultures were grown until the average OD 600 nm was 0.5-1.0 and protein expression was induced by adding IPTG (Teknova) to a final concentration of 1 mM. Expression cultures were incubated overnight in the Multitron instrument at 25° C. with 700 rpm shaking.

Fab proteins secreted into the E. coli periplasm were extracted for analysis. Cells were harvested by centrifugation at 2500×G, the supernatants were discarded and pellets were re-suspended in 75 µL ice-cold PPB buffer (Teknova). Extracts were incubated for 10 mins at 4° C. with 1000 rpm shaking, and 225 µL ice-cold ddH2O was added and incubated for a further 1 hr. The resulting periplasmic extract (PPE) was cleared by centrifugation at 2500×G and transferred to separate plates or tubes for ELISA and FACS analysis. All extraction buffers contained EDTA-free Complete Protease Inhibitors (Roche).

Each plate of samples also included duplicate "blank PPE" wells to serve as negative controls. These were created by intentionally leaving two 1 mL cultures un-inoculated and then processing them in the same way as the fab PPEs, thereby creating a sample with no bacterial growth and therefore no fab expression.

2.6.3. Primary screen by ELISA: Two 96-well plates of 5 PPE extracts per sub-campaign were tested for binding to PVRIG H:H by ELISA. Note that a non-biotinylated version of the protein was used for the ELISA screen to avoid the selection of biotin or streptavidin-binders. PVRIGHH recombinant protein was diluted to 2 µg/mL in phosphate buffered saline (PBS) and 50 µL aliquots were coated on the wells of a high binding EIA/RIA plate (Costar) overnight at 4° C. Coated plate wells were rinsed twice with PBS and incubated with 300 µL blocking buffer (5% skim milk powder in PBS pH 7.4) at room temperature (RT) for 1 hr. Blocking buffer was removed and plates were rinsed twice more with PBS. Plate-bound PVRIG was incubated with the PPEs, pre-blocked with 3% skim milk, at RT for 1 hr. Plates were washed three times with PBS-T (PBS 7.4, 0.05% Tween20), then three times with PBS and 50 µL/well HRP-conjugated, anti-human Fab secondary antibody (Jackson ImmunoResearch) was added at a 1:2000 dilution in 5% milk in PBS. This was incubated at RT for 1 hr and plates were washed again. ELISA signals were developed in all wells by adding 50 µL of Sureblue TMB substrate (KPL Inc) and incubating for 5-20 mins. The HRP reaction was stopped by adding 50 µL 2N H2SO4 (VWR) and absorbance signals at 450 nm were read on a SpectraMax (Molecular Devices) or EnVision (PerkinElmer) spectrophotometer. Wells that showed signal over background (blank PPE) ratio >3 were selected as positive hits.

2.6.4. Sequence analysis of ELISA positive fabs: The positive hits from the ELISA screen were selected and re-arrayed into a new 96-well plate. The clones were grown overnight at 37° C. and the plasmid DNA was sequenced using heavy chain and light chain-specific primers. The sequences were assembled and analyzed using Xabtracker (XOMA) software. The clones were deemed sequence-unique if there were more than one non-conservative differences in the heavy chain CDR3. Clones with same or similar heavy chain but significantly different light chains were labeled as siblings of the original clone.

2.6.5. FACS screening of fabs as PPEs: The sequence-unique ELISA-positive fab clones were selected and analyzed for their ability to bind PVRIG over-expressing cells by fluorescence-activated cell sorting (FACS). Analyses were conducted using HEK293 cells over-expressing the human PVRIG antigen. In a parallel experiment, un-transfected HEK293 cells were used as a negative control for each fab sample.

The PPEs for the sequence-unique ELISA-positive fab clones were generated as described above. All the assays were conducted using FACS buffer (1% BSA and 0.1% sodium azide in PBS). The human PVRIG and un-transfected HEK293 cells were harvested, washed twice and re-suspended at a density of 2×10⁶ cells/ml. A 25 µl aliquot of cells was mixed with 25 µl of each PPE sample and incubated for 1 hr at 4° C. with gentle shaking. Two blank PPE controls were also included in the analysis. Plates were washed one time in 200 µl of FACS buffer and 50 µL, of a 2 µg/mL dilution of a mouse anti-C-myc antibody (Roche) was added to each well. After incubation for 30 mins at 4° C., cells were washed again and 25 µl of a 5 µg/mL dilution of goat anti mouse fab-AF647 (Jackson Immunoresearch) was added to each PPE and negative control well. All secondary antibodies were incubated for 30 min at 4° C. After two washes, cells were re-suspended in a final volume of 50 µl of fixation buffer (2% paraformaldehyde in FACS buffer). Samples were read on an Intellicyt HTFC screening system, recording approximately 5000 events per well in a designated live gate. Data was analyzed using FlowJo (De Novo Software, CA, USA) and exported to Excel. Ratio of Mean Fluorescence Intensity (MFI) for the human PVRIG over-expressing HEK cells and the un-transfected 293 cells was calculated using Xabtracker software (XOMA). Positive hits on each plate were identified as those giving an MFI ratio 5-fold greater than the averaged blank PPE control signal.

Re-Formatting of Fab Hits and Production as Human IgG Molecules:

Potential PVRIG binding fabs were converted to full length human IgGs for further characterization. Protein expression constructs were derived by PCR-amplification of variable heavy, lambda and kappa domain genes, which were sub-cloned into pFUSE-CHIg-hG1 (human IgG1 heavy chain), pFUSE2-CLIg-hK (human kappa light chain) or pFUSE2-CLIg-hL2 (human lambda 2 light chain) vectors, respectively (all expression vectors were sourced from Invivogen).

Expi293 cells (Life Technologies) were seeded at 6×10⁵ cells/ml in Expi293 medium (Life Technologies) and incubated for 72 hrs at 37° C. in a humidified atmosphere of 8% CO2 with shaking at 125 rpm. This cell stock was used to seed expression cultures at 2.0×10⁶ cells/ml in Expi293 medium. These cultures were incubated as above for 24 hrs with shaking at 135 rpm.

For transfection, cells were diluted again to 2.5×10⁶ cells/ml in Expi293 medium. The protein expression constructs for antibody heavy chain and light chain were mixed at a ratio of 1:2. For every 30 mL of expression culture volume, 30 µg of DNA and 81 µl of Expifectamine (Life Technologies) were each diluted separately to 1.5 mL with Opti-MEM (Life Technologies) and incubated for five minutes. Diluted DNA and Expifectamine were then mixed and incubated at RT for 20 mins. This was then added to the expression culture in a shaker flask and incubated as described above, with shaking at 125 rpm.

Approximately 20 hrs post-transfection, 150 µL of Expi-Fectamine 293 transfection Enhancer 1 and 1.5 mL of ExpiFectamine 293 Transfection Enhancer 2 was added to each flask. Cultures were incubated for a further five days (six days post-transfection in total) and supernatants were harvested by centrifugation. IgGs were purified from the supernatants using an AKTA Pure FPLC (GE Healthcare Bio-Sciences) and HiTrap MabSelect Sure affinity columns (GE Healthcare Bio-Sciences) according to manufacturer's instructions.

FACS Screening of Reformatted IgG1 Antibodies:

FACS screening of the reformatted antibodies was done similarly to the PPE based screen described herein, except that a dose-dependent titration of the purified antibodies was performed. The human PVRIG over-expressing HEK293 cells, or the un-transfected HEK293 cells, were incubated with varying concentrations (0-10 µg/ml) of the anti PVRIG antibodies or isotype controls in FACS buffer at 4° C. for 60 mins. Cells were washed once in FACS buffer, re-suspended in 50 µl of Alexa Fluor 647 conjugated anti-human IgG (Fab fragment specific) diluted 1:200 and incubated for 30 mins at 4° C. in the dark. Cells were washed twice and re-suspended in a final volume of 80 µl of FACS buffer and Propidium Iodide (Biolegend cat#421301) diluted 1:1000. Samples were analyzed using an Intellicyt HTFC screening system (Intellicyt). Data was analyzed using FlowJo (De- Novo), exported to Excel (Microsoft) and plotted in Graph-Pad Prism (GraphPad Software, Inc.).

Results

Functional QC of the PVRIG H:H Recombinant Protein:

The purity of the PVRIG H:H protein was assessed by microfluidics capillary electrophoresis using a LabChip system. Under reducing conditions, the recombinant protein migrated at 80 kDa, consistent with its calculated molecular weight of 80.4 kDa, and showed 99% purity (data not shown). Under non-reducing conditions, one additional peak was observed which likely resulted from the presence of a dimeric form of the protein due to Fc-Fc interaction.

The functional integrity of the recombinant protein was assessed by evaluating its binding to PVRL2 (a known ligand for PVRIG) in ELISA. A dose-dependent response was observed for the binding of PVRIG H:H to PVRL2 (data not shown). In comparison, no binding was observed for a irrelevant human IgG1 Fc control. Taken together, this indicated that the PVRIG H:H recombinant protein is of high purity and is functionally active, and thus is suitable for biopanning.

QC of the Biotinylated PVRIG H:H Recombinant Protein:

The purity of the biotinylated PVRIGHH protein was assessed by microfluidics capillary electrophoresis using LabChip system. No significant differences were observed between the non-biotinylated and the biotinylated recombinant proteins (data not shown). Note that an additional 44.3 kDa peak observed in the biotinylated protein sample. This peak may result from the monomeric form of the PVRIG H:H protein or maybe an artifact of the quenching reaction of the biotinylation kit.

Successful biotinylation was confirmed by incubating the biotinylated protein on a streptavidin-coated EIA plate and detecting the bound protein using a HRP-conjugated anti human IgG1 Fc secondary antibody. The binding of biotinylated PVRIG H:H to the streptavidin-coated EIA plate was comparable to a commercially sourced irrelevant biotinylated protein (data not shown).

Phage Panning:

The biotinylated PVRIG H:H protein was used for phage panning against the XOMA031 human fab antibody phage display library (XOMA Corporation, Berkeley, Calif.). Three rounds of biopannings were performed, under 4 different combinations of washing stringency, antigen concentration, and depletion of Fc binders (sub-campaigns A-D). The success of each round was estimated using the phage output titers. Qualitative guidelines were used to define the success of the panning sub-campaigns, such as significant reduction in phage titers after round 1, increase or maintenance of phage titers after rounds 2 and 3, and decrease in phage titers upon increasing wash stringency or decreasing antigen concentration. All 4 sub-campaigns resulted in phage titers in the expected range that were consistent among the sub-campaigns (data not shown).

Screening of Phage Output as Fab PPEs:

Two 96-well plates of fab clones (as PPEs) for each of the four sub-campaigns were screened to evaluate the success of biopanning. The results are summarized in table 3 and are discussed in further detail below. Overall, all 4 sub-campaigns yielded significant numbers of PVRIG H:H specific fabs. A total of 49 target-specific unique fabs were identified. The sub-campaigns B and D showed the highest ELISA hit rates and FACS correlation and were selected for an extended screen.

TABLE 3

Summary of pilot screen of fab PPEs. For each sub-campaign, the total number of clones screened, ELISA hits, FACS hits and sequence uniqueness are listed. Open reading frames (ORFs) represent the clones that were successfully sequenced as a full-length fab. Specificity is based on the lack of non-specific binding to irrelevant proteins in ELISA. FACS correlation represents the percent of ELISA hits that were also FACS positive (specifically bound to PVRIG over-expressing HEK293 cells).

|  | Sub A | Sub B | Sub C | Sub D | Overall |
| --- | --- | --- | --- | --- | --- |
| Clones screened | 182 | 182 | 182 | 182 | 728 |
| ELISA positive (>3 S/N) | 48 | 51 | 44 | 68 | 211 |
| ELISA Hit rate | 26% | 28% | 24% | 37% | 29% |
| ORFs | 36 (75%) | 45 (88%) | 35 (80%) | 63 (93%) | 179 (85%) |
| Unique sequences | 25 | 21 | 17 | 31 | 73 |
| Diversity | 69% | 47% | 49% | 49% | 41% |
| Specificity by ELISA* | 100% | 100% | 100% | 100% | 100% |
| FACS Binders (>5 S/N) | 14 | 17 | 14 | 24 | 49** |
| FACS correlation | 56% | 81% | 82% | 77% | 67% |

*No non-specific binding to irrelevant Fc conjugates or PVRL2; ** 35 unique HCs, 14 siblings Primary Fab Screen (ELISA):

Two 96-well plates (182 fab clones) of PPEs for each sub-campaign were screened by ELISA against the PVRIG H:H recombinant protein. Note that although biotinylated protein was used for panning, the non-biotinylated version was used for the ELISA screen, which avoided detection of biotin or streptavidin-specific binders. The 4 sub-campaigns resulted in ELISA hit rates ranging from 24-37% when the threshold for a 'positive' signal was set at a 3-fold ratio of target-specific binding: blank PPE control signal.

Secondary Screen (DNA Sequence Analysis, ELISA and FACs) Fabs:

The ELISA positive clones were sequenced to select non-redundant fabs. Seventy-three sequence-unique fab clones were identified. 19 clones were unique to sub-campaign A, 13 clones were unique to sub-campaign B, 10 clones were unique to sub-campaign C, 18 clones were unique to sub-campaign D, while the remaining 23 clones were shared between the campaigns. Sequence-unique, ELISA-positive fab clones were re-expressed as PPEs and screened for specific binding by FACS. A total of 49 out of 73 unique clones were identified as PVRIG specific ELISA and FACS binders (following the criteria established in 2.6.5). The 49 FACS binders corresponded to 35 antibodies with unique heavy chains and 14 siblings that have unique light chains but share the heavy chain with one of the unique clones. A summary of FACS binding data is presented in Table 4.

The sequence unique fabs were also tested for non-specific binding. All the fab PPEs analyzed bound to the PVRIG H:H recombinant protein with an assay signal greater than 3-fold over the blank PPE control. In a parallel assay, fab PPEs were tested for binding to two irrelevant proteins with the same IgG1 Fc region, as well as the PVRL2 recombinant protein. None of the clones showed significant non-specific binding to the controls, suggesting that the selected fabs are specific for PVRIG.

TABLE 4

FACS binding summary for PVRIG fabs. All unique ELISA positive fabs were analyzed by FACS. The mean fluorescence intensity (MFI) was measured for the PVRIG over-expressing HEK293 cells as well as the un-transfected HEK293 cells. The MFI ratio for the target-specific vs off-target binding was calculated. Clones with MFI ratio >5 were selected as hits and are listed below.

| fab clone | MFI ratio |
| --- | --- |
| CPA.7.001 | 11 |
| CPA.7.002 | 8.9 |
| CPA.7.003 | 9.5 |
| CPA.7.004 | 9.3 |
| CPA.7.005 | 6.5 |
| CPA.7.006 | 9.6 |
| CPA.7.007 | 14 |
| CPA.7.008 | 14 |
| CPA.7.009 | 10 |
| CPA.7.010 | 7.6 |
| CPA.7.011 | 10 |
| CPA.7.012 | 19 |
| CPA.7.013 | 12 |
| CPA.7.014 | 14 |
| CPA.7.015 | 15 |
| CPA.7.016 | 7.6 |
| CPA.7.017 | 13 |
| CPA.7.018 | 7.8 |
| CPA.7.019 | 16 |
| CPA.7.020 | 6.9 |
| CPA.7.021 | 15 |
| CPA.7.022 | 7.5 |
| CPA.7.023 | 12 |
| CPA.7.024 | 9.8 |
| CPA.7.025 | 6 |
| CPA.7.026 | 5.3 |
| CPA.7.027 | 9.2 |
| CPA.7.028 | 17 |
| CPA.7.029 | 6.7 |
| CPA.7.030 | 15 |
| CPA.7.031 | 8.5 |
| CPA.7.032 | 7.6 |
| CPA.7.033 | 22 |
| CPA.7.034 | 7.7 |
| CPA.7.035 | 14 |
| CPA.7.036 | 5 |
| CPA.7.037 | 5.3 |
| CPA.7.038 | 6.3 |
| CPA.7.039 | 12 |
| CPA.7.040 | 12 |
| CPA.7.041 | 7.6 |
| CPA.7.042 | 5.4 |
| CPA.7.043 | 13 |
| CPA.7.044 | 7.9 |
| CPA.7.045 | 7.8 |
| CPA.7.046 | 10 |
| CPA.7.047 | 8.4 |
| CPA.7.049 | 10 |
| CPA.7.050 | 22 |

Reformatting of the ELISA and FACS Positive Fabs into hIgG1:

All unique ELISA and FACS binders were reformatted for expression as human IgG1 molecules in Expi293 cells. Out of the original 49 antibodies, 44 were successfully expressed as full-length antibodies. These reformatted antibodies were tested for retained binding to PVRIG over-expressing HEK293 cells alongside an irrelevant human IgG1 isotype control. All antibodies were also tested against un-transfected HEK293 cells. The resulting binding results were used to demonstrate the specificity of the antibodies and also plotted to calculate the equilibrium binding constant (KD). Nine out of the remaining 44 antibodies showed weak binding or significant non-specific binding. The remaining 35 antibodies were selected for further analysis in cell-based functional assays. The FACS-based KD of these antibodies are listed in Table 6. The KD values range from 0.30 nM to 96 nM, with a median of 9.4 nM, suggesting that most antibodies obtained from the panning campaign are very specific and bind to PVRIG with high affinity.

TABLE 5

Expression and binding summary of reformatted antibodies. All unique ELISA and FACS positive fabs were reformatted into the human IgG1 backbone. FACS KD values were determined by dose titration against the PVRIG over-expressing HEK293 cells. Off-target binding was determined by dose titration against the un-transfected HEK293 cells.

| Antibody | FACS KD (nM) |
| --- | --- |
| CPA.7.001 | No-expression |
| CPA.7.002 | 44.35 |
| CPA.7.003 | Non-specific binding |
| CPA.7.004 | 21.71 |
| CPA.7.005 | 95.56 |
| CPA.7.006 | No-expression |
| CPA.7.007 | 0.73 |
| CPA.7.008 | No-expression |
| CPA.7.009 | 33.00 |
| CPA.7.010 | 21.89 |
| CPA.7.011 | 66.02 |
| CPA.7.012 | 0.30 |
| CPA.7.013 | No-expression |
| CPA.7.014 | 2.04 |
| CPA.7.015 | 1.34 |
| CPA.7.016 | 22.02 |
| CPA.7.017 | 1.82 |
| CPA.7.018 | 9.29 |
| CPA.7.019 | 0.45 |
| CPA.7.020 | 86.97 |
| CPA.7.021 | 11.22 |
| CPA.7.022 | 4.17 |
| CPA.7.023 | 4.08 |
| CPA.7.024 | 9.08 |
| CPA.7.025 | Non-binder |
| CPA.7.026 | Non-binder |
| CPA.7.027 | Non-binder |
| CPA.7.028 | 7.14 |
| CPA.7.029 | Weak binding |
| CPA.7.030 | No-expression |
| CPA.7.031 | Non-binder |
| CPA.7.032 | 8.78 |
| CPA.7.033 | 12.8 |
| CPA.7.034 | 14.2 |
| CPA.7.035 | Non-binder |
| CPA.7.036 | 6.0 |
| CPA.7.037 | Non-specific binding |
| CPA.7.038 | 20.26 |
| CPA.7.039 | 3.76 |
| CPA.7.040 | 0.79 |
| CPA.7.041 | 52.2 |
| CPA.7.042 | 24.26 |
| CPA.7.043 | 13.2 |
| CPA.7.044 | 9.4 |
| CPA.7.045 | 3.73 |
| CPA.7.046 | Non-specific binding |
| CPA.7.047 | 5.36 |
| CPA.7.049 | 19.9 |
| CPA.7.050 | 68.3 |

Summary and Conclusions

A phage display antibody discovery campaign was conducted to isolate binders against the immuno-oncology target PVRIG using a recombinant Fc-tagged version of the antigen. Quality control analysis showed that the panning antigen was pure and functionally active. The panning effort yielded 49 unique fab clones that specifically bound to the PVRIG target, both as a recombinant protein and on the cell surface. Of these, 35 were successfully produced as human IgG1 antibodies and were shown to retain specific binding to the PVRIG. This pool of antibodies displayed high affinities in a FACS assays, with 18 out of 35 antibodies binding with a KD<10 nM.

Example 10 Demonstration of the Ability of the Anti-Human PVRIG Fabs to Block the Interaction Between PVRIG and PVRL2 by ELISA Method:

The human PVRL2-His (Catalog #2229-N2-050/CF, R&D Systems), was coated on the ELISA plate. Fab periplasmic extracts (PPEs), diluted 1:1 in 5% skim milk, were preincubated with 1 µg/ml (final concentration) of the human PVRIG-Fc, for 15 min at RT. The fab-receptor mixture was allowed to bind the PVRL2-His coated on the ELISA plate. The PVRIG-Fc/ PVRL2-His interaction was probed using anti-human Fc antibody, conjugated to HRP (Jackson Immuno Research catalog #709-035-098). In the absence of PPE (negative wells), a strong positive signal was expected. For blocking fabs, the signal would be significantly reduced. The fab clones with >5-fold lower signal than the negative wells (>80% blocking) could be selected as blocking fabs.

Protocol:

ELISA plates (Costar 9018) were coated with 50 ul of 2 µg/ml antigen and were stored at 4 C overnight. The antigen-coated plates were washed 3 times with 1×PBS. The plate was blocked with 200 µl of 5% skim milk in PBS and incubated 1 hr at RT (room temperature). Next the plate was washed with 1× PB.

After adding 50 µl/well of Fab PPEs (diluted in 5% skim milk), the plate was preincubated with 1 µg/ml of the human PVRIG-Fc that was added to the respective wells. The "no fab" control was performed with 2 wells.

The plate was incubated 1 hr at RT.

The plates were washed 3 times with 1×PBST and 3 times with 1×PBS.

After adding 50 µl/well of the HRP-conjugated secondary antibody (Jackson Immuno Research, 709-035-098), diluted in 5% milk in PBS, the plate was incubated 1 hr at RT.

The plates were washed 3 times with 1×PBST and 3 times with 1×PBS.

After adding 50 µl/well of the TMB substrate and waiting until the color develops, the reaction was stopped by adding 50 µl/well of 2N H2SO4. Absorbance was measured at 450 nm.

Results

FIGS. 52A-52B shows the results of testing anti-PVRIG antibodies for their ability to block at least 80% of PVRL2 binding to PVRIG. As shown, a large number of such antibodies were able to successfully block at least 80% of the binding. Specifically the antibodies which blocked successfully are designated as follows:

CPA.7.001, CPA.7.003, CPA.7.004, CPA.7.006, CPA.7.008, CPA.7.009, CPA.7.010, CPA.7.011, CPA.7.012, CPA.7.013, CPA.7.014, CPA.7.015, CPA.7.017, CPA.7.018, CPA.7.019, CPA.7.021, CPA.7.022, CPA.7.023, CPA.7.024, CPA.7.033, CPA.7.034, CPA.7.036, CPA.7.040, CPA.7.046, CPA.7.047, CPA.7.049, CPA.7.050,

Example 11: Surface Plasmon Resonance Study of Epitope Binning of 37 Anti PVRIG IgG Antibodies Binding to Human PVRIG Fusion Protein Materials and Methods Experiments were performed using a ProteOn XPR 36 instrument at 22° C. with all samples kept at 4° C. during the experiment.

Step 1: The following anti-PVRIG mAbs were each diluted to ~10 µg/mL in 10 mM sodium acetate, pH 5.0 and covalently immobilized on independent spots on a ProteOn GLC biosensor chip using standard amine coupling:

| |
|---|
| CPA.7.002 |
| CPA.7.003 |
| CPA.7.004 |
| CPA.7.005 |
| CPA.7.007 |
| CPA.7.009 |
| CPA.7.010 |
| CPA.7.011 |
| CPA.7.012 |
| CPA.7.014 |
| CPA.7.015 |
| CPA.7.016 |
| CPA.7.017 |
| CPA.7.018 |
| CPA.7.019 |
| CPA.7.020 |
| CPA.7.021 |
| CPA.7.022 |
| CPA.7.023 |
| CPA.7.024 |
| CPA.7.026 |
| CPA.7.028 |
| CPA.7.029 |
| CPA.7.032 |
| CPA.7.033 |
| CPA.7.034 |
| CPA.7.036 |
| CPA.7.037 |
| CPA.7.038 |
| CPA.7.039 |
| CPA.7.040 |
| CPA.7.043 |
| CPA.7.045 |
| CPA.7.046 |
| CPA.7.047 |
| CPA.7.050 |

The activation step occurred in the horizontal flow direction for five minutes while the immobilization step occurred in the vertical flow direction. MAbs were injected for four minutes after surface activation. The blocking step occurred in both the vertical and horizontal positions at five minutes each so that the horizontal "interspots" could be used as reference surfaces. MAbs were immobilized at a range of ~450 RU-5000 RU. An additional mAb CPA.7.041 was also binned in this study, but only as an analyte in solution. See below.

Step 2: Preliminary experiments involved several cycles of injecting ~20 nM PVRIG antigen (PVRIG H:H-2-1-1 #448, GenScript) over all immobilized mAbs for three minutes at a flow rate of 25 µL/min followed by regeneration with a 30-second pulse of 10 mM glycine-HCl, at either pH 2.0 or pH 2.5, depending on the horizontal row of mAbs in the GLC chip array. Antigen samples were prepared in degassed PBST (PBS with 0.05% Tween 20) running buffer with 100 µg/mL BSA. These preliminary experiments showed that clones CPA.7.026 and CPA.7.029 did not bind to the antigen and were therefore not binned. The remaining mAbs on the ProteOn array showed reproducible binding to the antigen.

Step 3: A "pre-mix" epitope binning protocol was performed because of the bivalency of the fc-fusion PVRIG antigen. In this protocol each mAb listed in Step 1, plus mAb CPA.7.041, was pre-mixed with PVRIG antigen and then injected for three minutes over all immobilized mAbs. The molar binding site concentration of each mAb was in excess of the molar antigen binding site concentration. The final binding site concentration of each mAb was ~400 nM and the final binding site concentration of the antigen was ~20 nM. An antigen-only control cycle was performed after very eight mAb injection cycles to monitor the activity of the immobilized mAbs throughout the experiment. Buffer blank injections were also performed after about every eight mAb injection cycles for double-referencing. Additional controls included each mAb injected alone over all immobilized mAbs at concentrations identical to the pre-mix injection cycles. All surfaces were regenerated with a 30 second pulse of 10 mM glycine-HCl at either pH 2.0 or pH 2.5 depending on which row of mAbs in the array was being regenerated, and all cycles were run at a flow rate of 25 µL/min. MAb and antigen samples were prepared in degassed PBST running buffer with 100 µg/mL BSA.

Step 4: Sensorgram data were processed and referenced using ProteOn Manager Version 3.1.0.6 using interspots and buffer blanks for double-referencing. The mAb-only control injections were used as the injection references where significant binding with the mAb-only injections was observed. An antibody pair was classified as having a shared antigen binding epitope (designated as a red "0" in the matrix in FIG. 43) if no binding was observed from the injection of mixed mAb and antigen over the immobilized mAb, or if binding was significantly reduced as compared to the antigen-only control injection over the same immobilized mAb. An antibody pair was classified as binding to different antigen epitopes, or "sandwiching" the antigen (designated as a green "1" in the matrix in FIG. 43) if the injection of mixed mAb and antigen showed binding to the immobilized mAb similar to or greater than the antigen-only control over the same immobilized mAb.

Step 5: The blocking pattern for mAb CPA.7.041 (#37) was studied only as an analyte because the GLC chip array has only 36 spots. Therefore for consistency, hierarchical clustering of the binding patterns in the binary matrix for each mAb pre-mixed with antigen (vertical patterns in FIG. 42) was performed using JMP software version 11.0.0. The blocking patterns of the immobilized mAbs (horizontal patterns in FIG. 42) were also clustered as a comparison to the blocking patterns of the mAbs pre-mixed in solution (data not shown, see Results for discussion).

Figure 43:
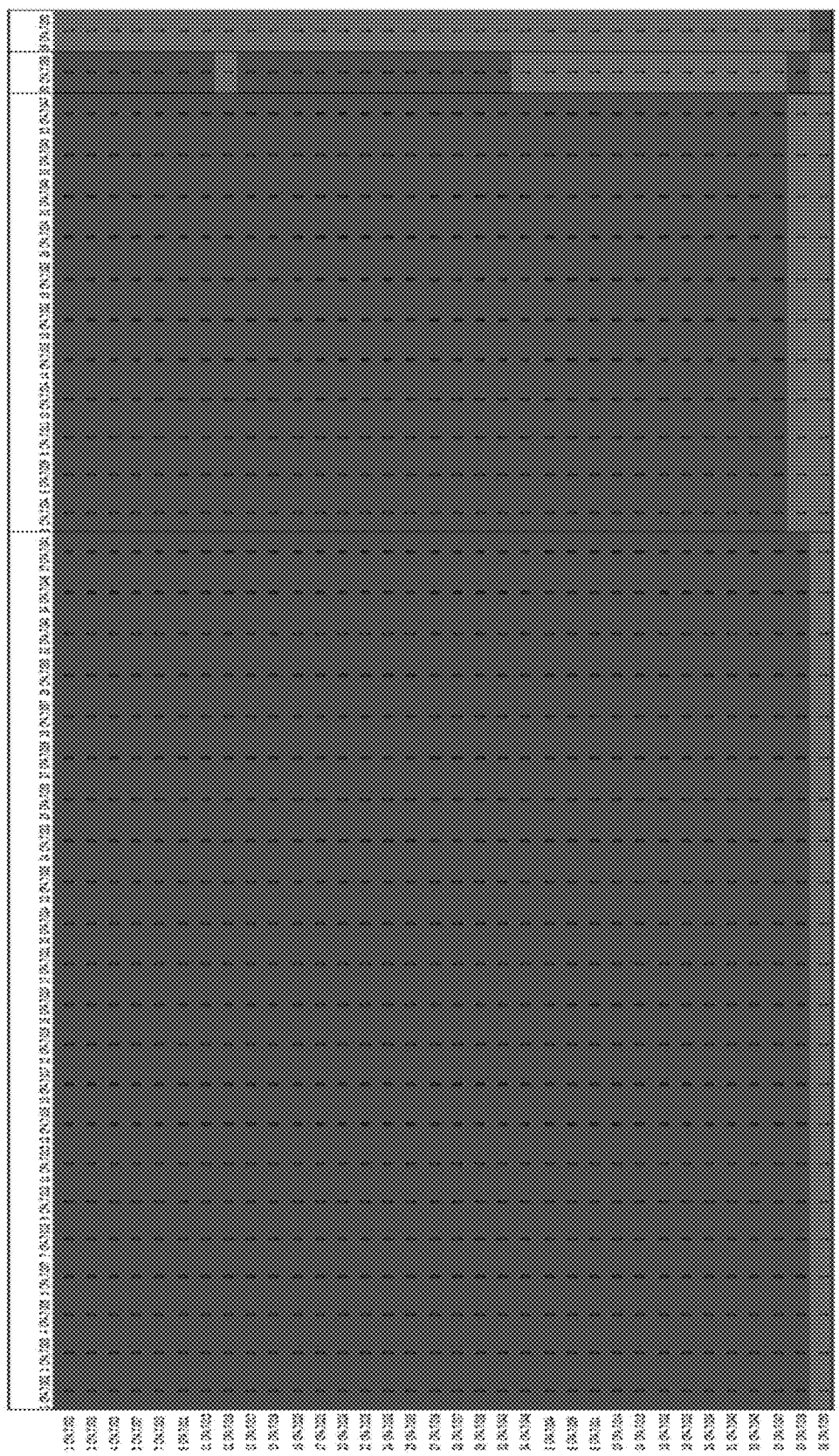
FIG. 43 Binary matrix of pair-wise blocking ("0", red box) or sandwiching ("1", green box) of antigen for 35 anti-PVRIG mAbs. MAbs listed vertically on the left of the matrix are mAbs covalently immobilized to the ProteOn array. MAbs listed horizontally across the top of the matrix were analytes injected with pre-mixed antigen. Clone CPA.7.041 was studied only as an analyte. The black boxes outline four epitope bins according to the vertical blocking patterns of the mAbs.
Figure 44:
FIG. 44 Hierarchical clustering dendrogram of the vertical binding patterns of each mAb in the binary matrix in FIG. 43. There are four bins of mAbs with identical epitope blocking patterns within each group. The only difference between bins 1 and 2 is mAbs in bin 1 block antigen binding to clone CPA.7.039 while mAbs in bin 2 can sandwich the antigen with CPA.7.039. Clone CPA.7.050 can sandwich the antigen with all other clones.
Figures 45A, 45R:
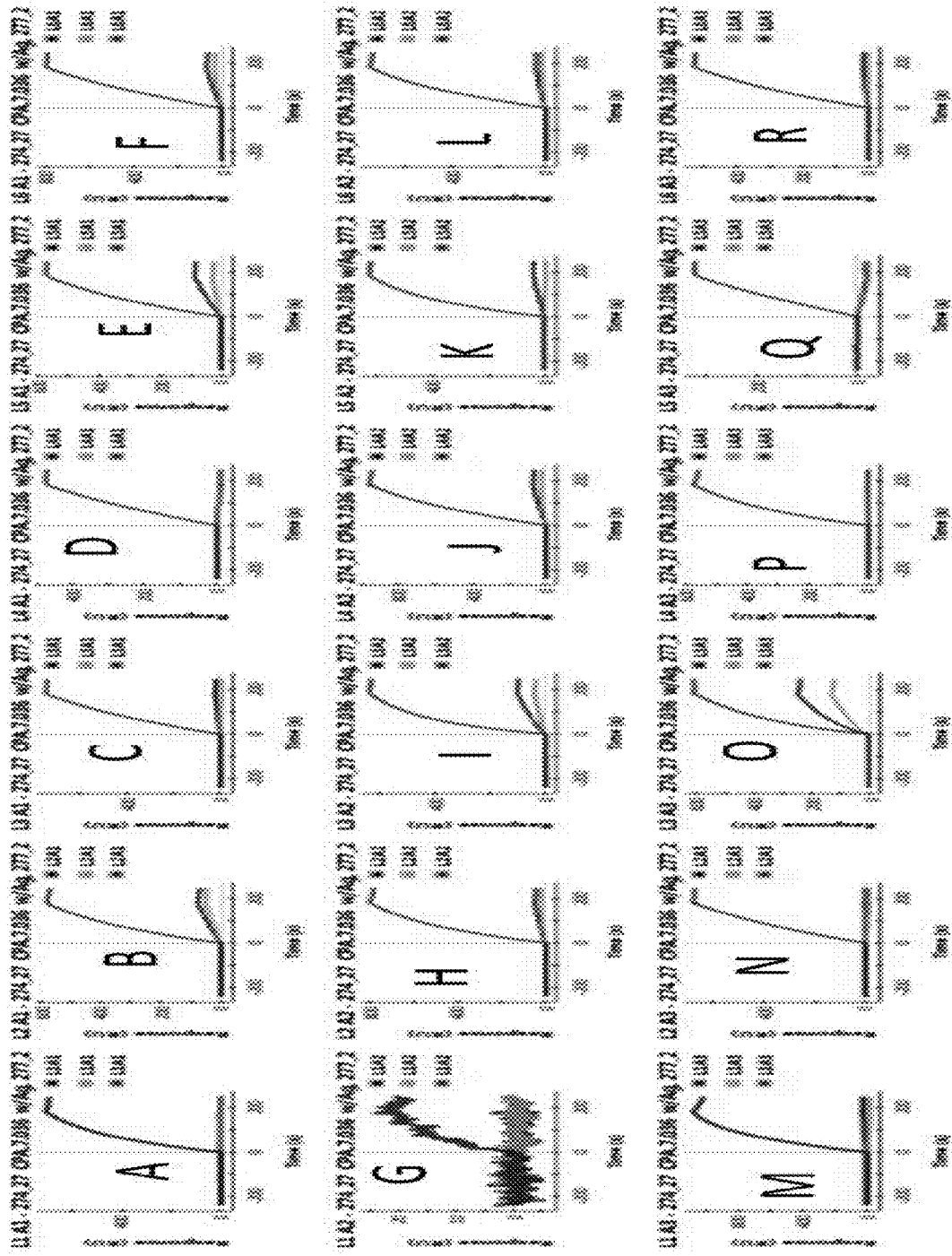
Figures 45J, 45S:
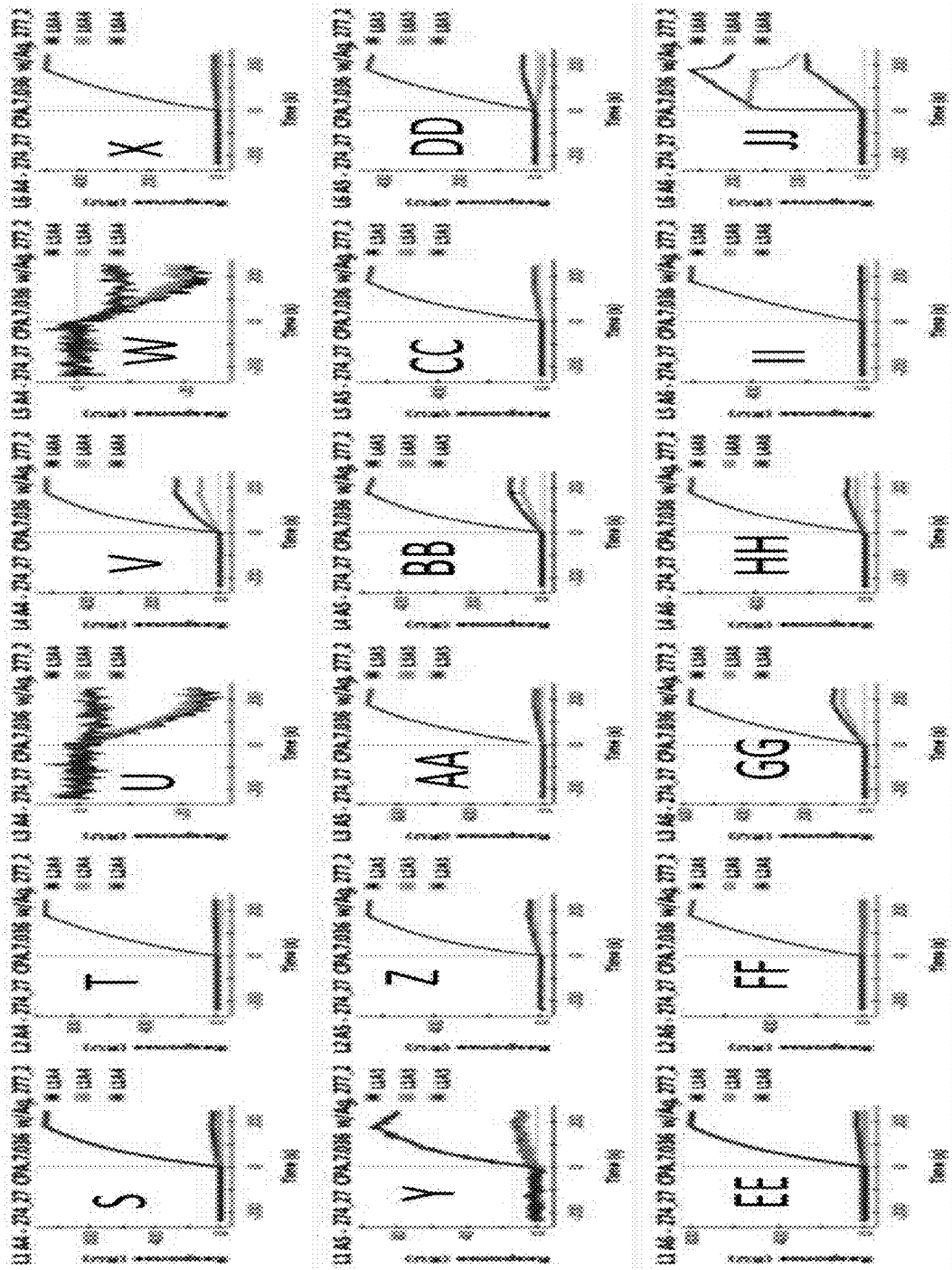
Figures 46A, 46R:
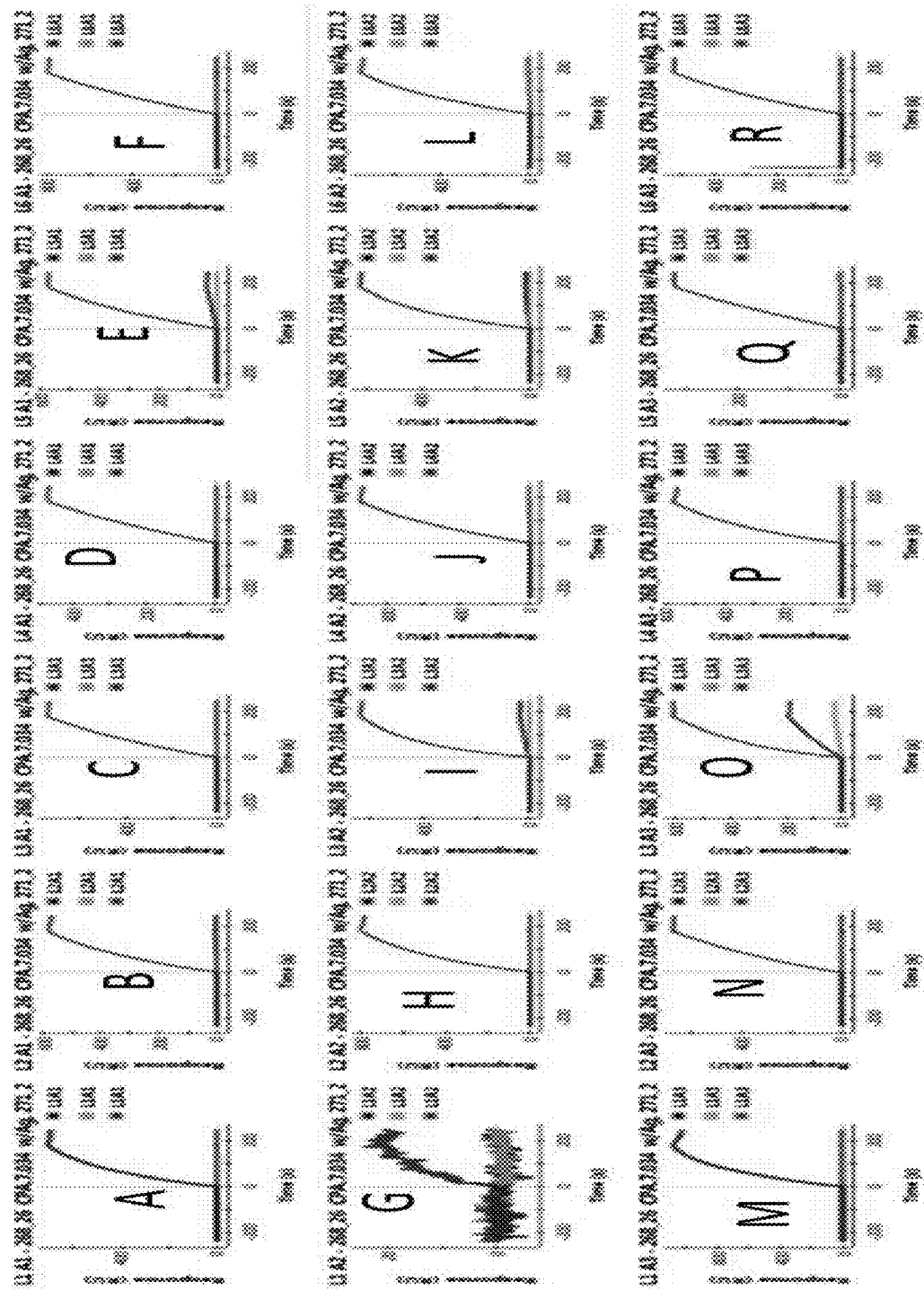
Figures 46J, 46S:
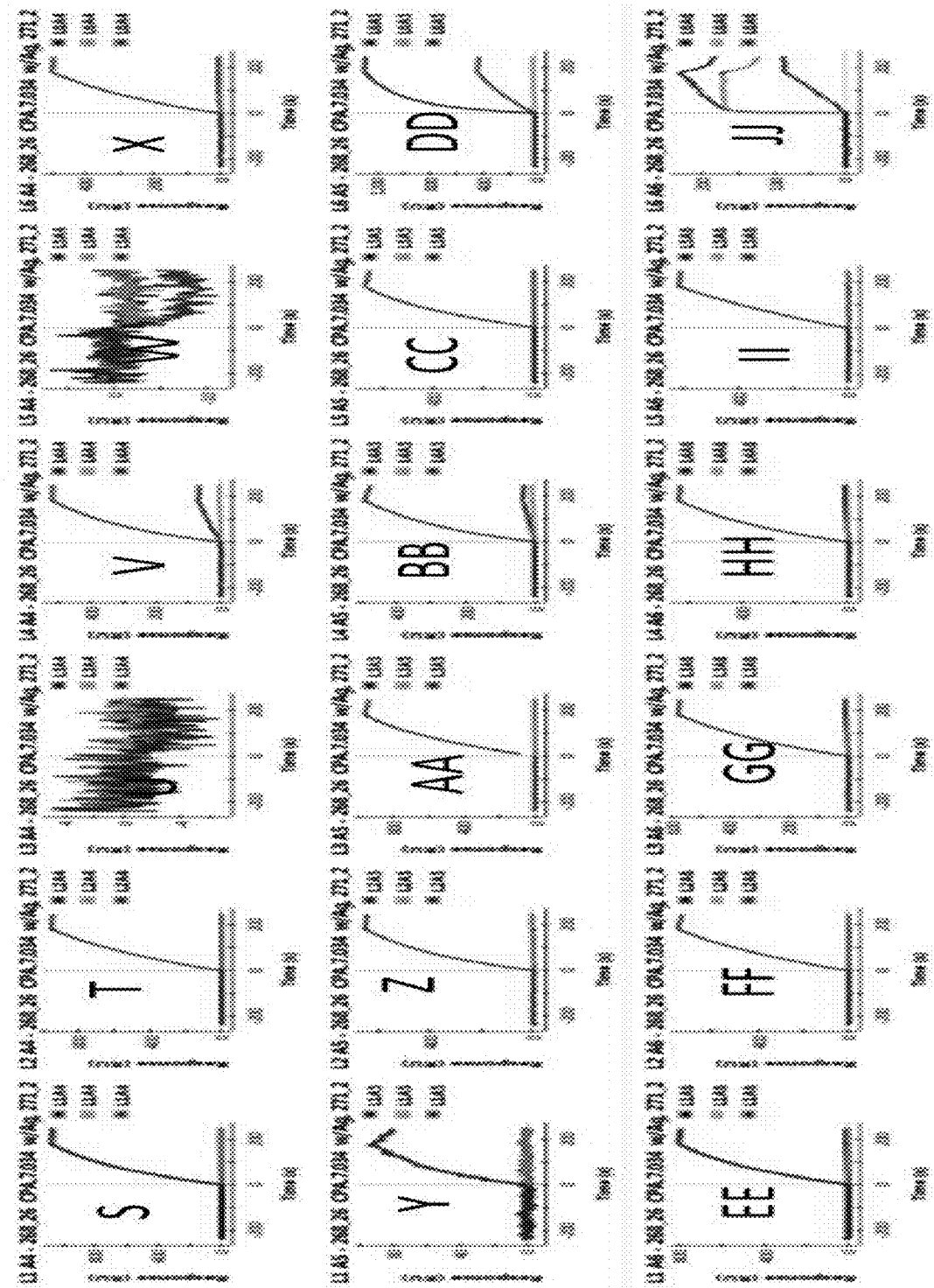
Figures 47A, 47R:
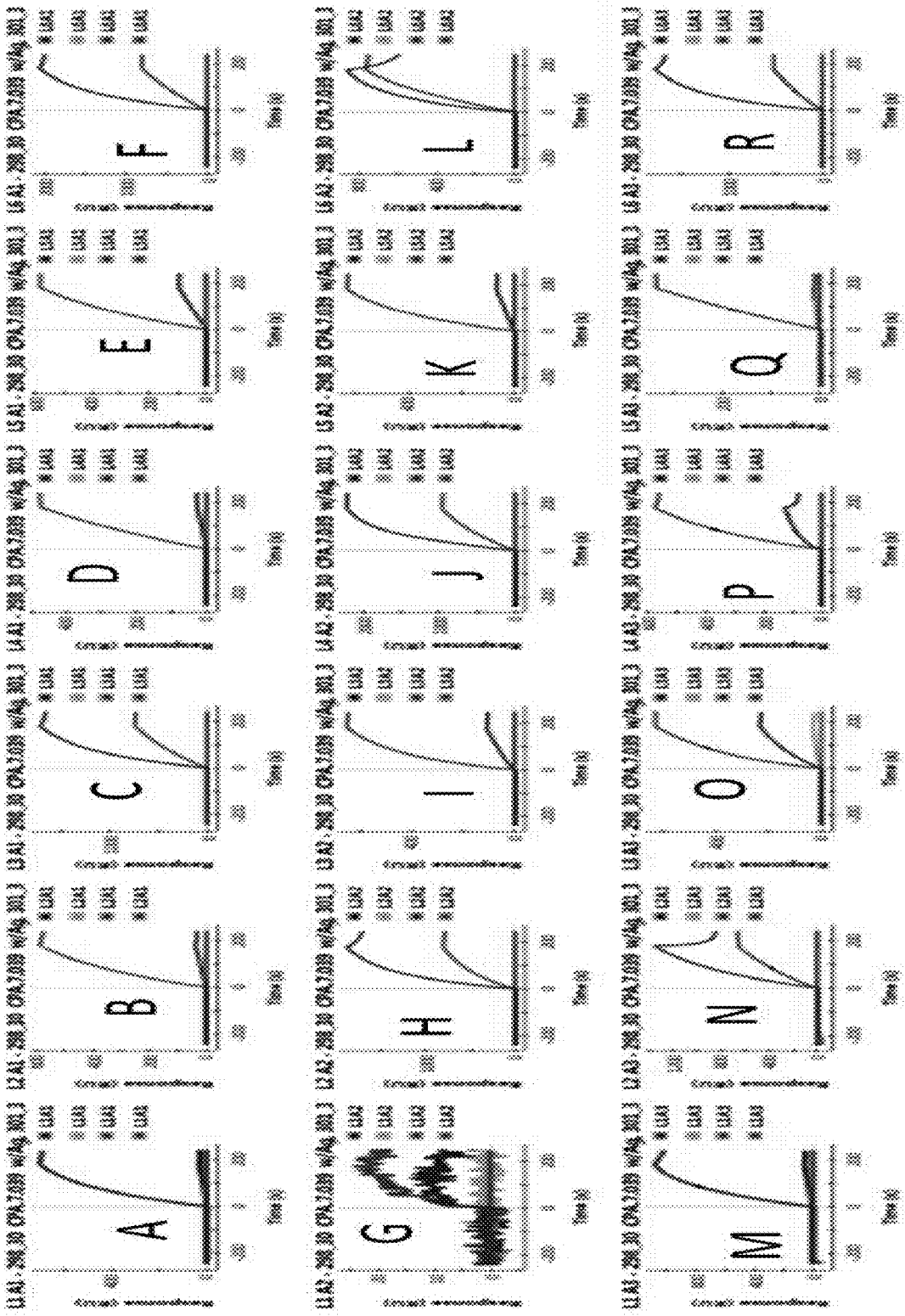
Figures 47J, 47S:
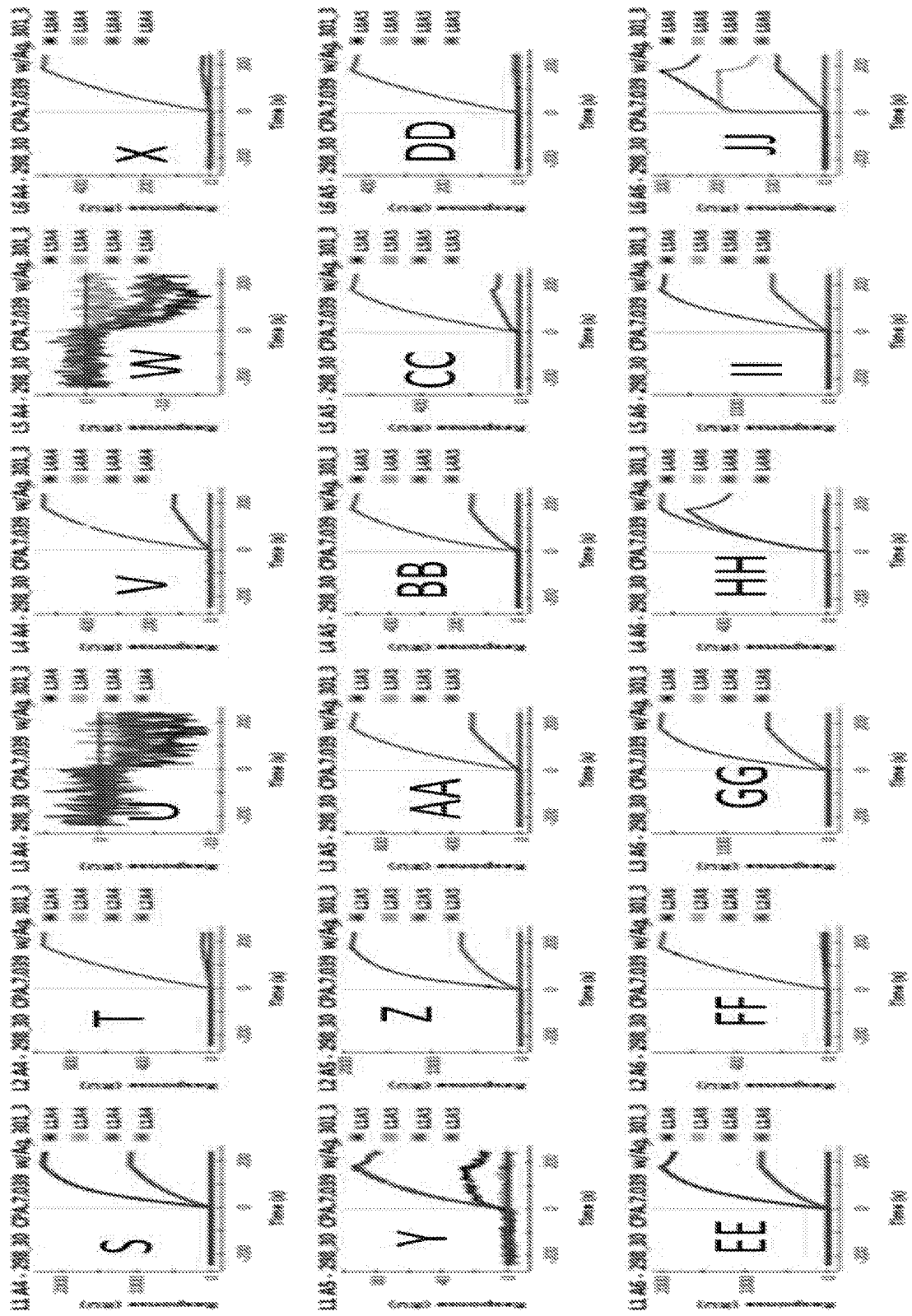
Figures 48A, 48R:
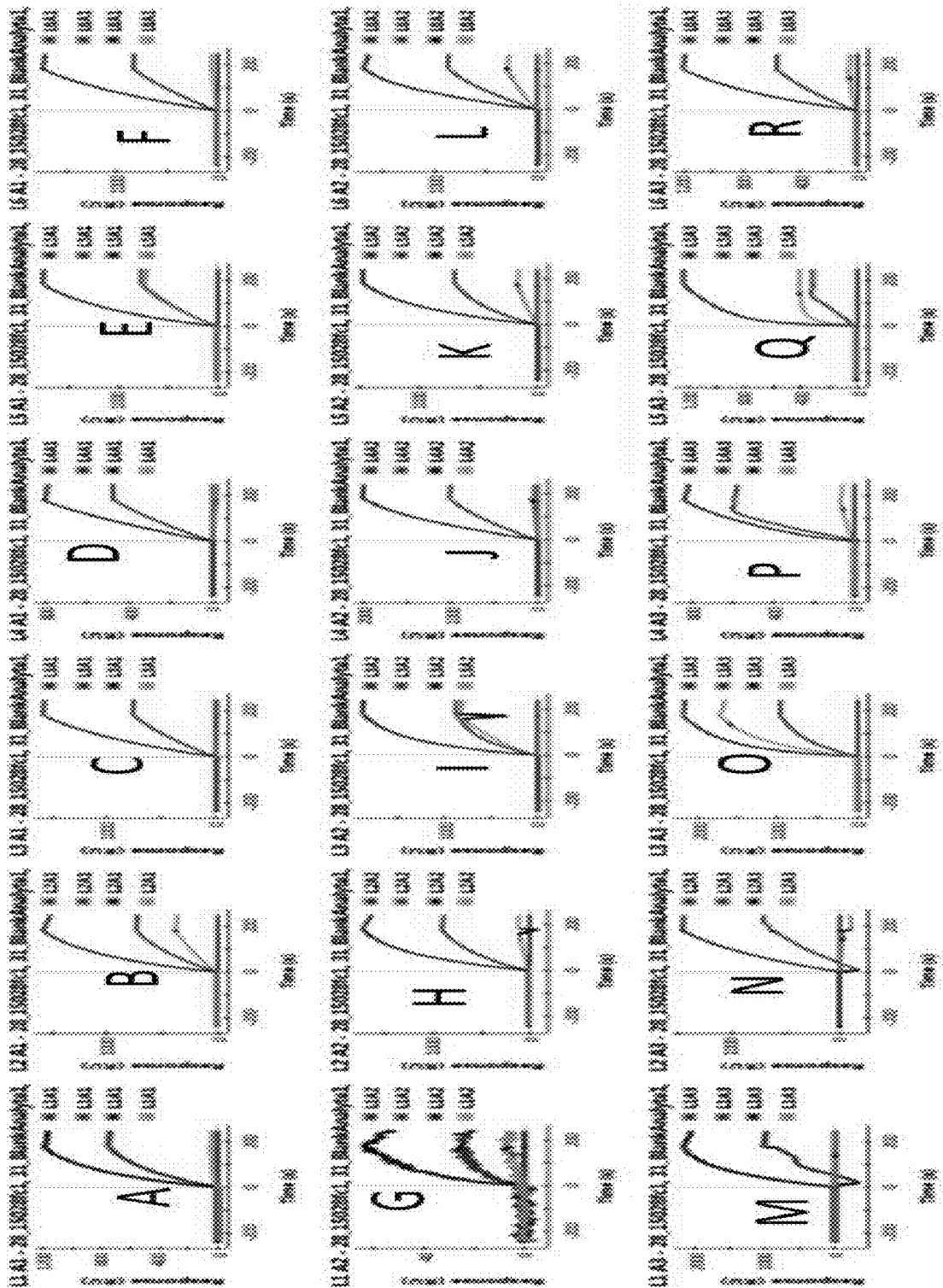
Figures 48J, 48S:
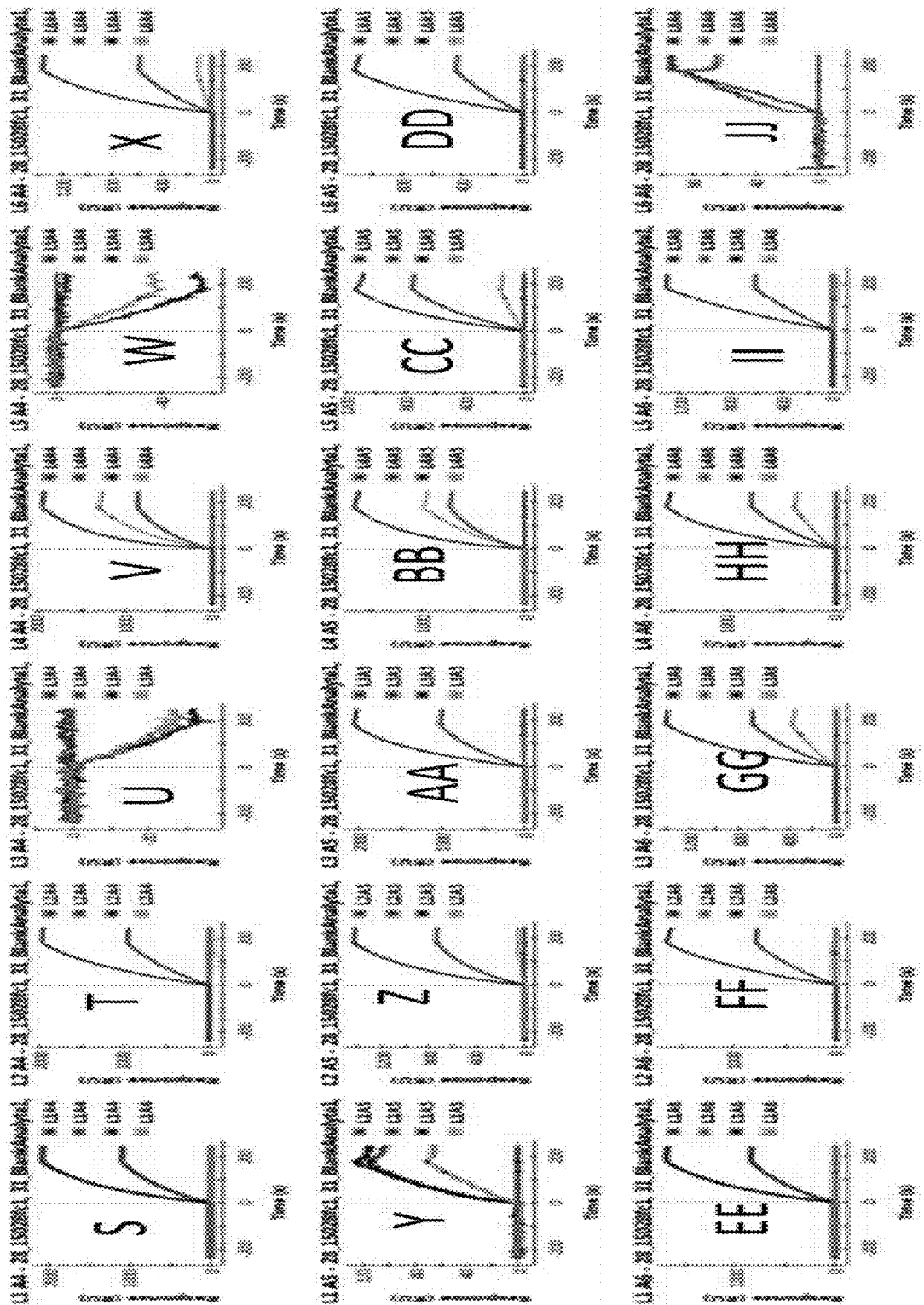

Results:

FIG. 42 shows the binary matrix of the blocking ("0") or sandwiching ("1") between each mAb pair where the mAbs are listed in identical order both vertically (mAbs on the surface—"ligands") and horizontally (mAbs in solution—"analytes"). Identical "bins" of blocking patterns for all mAbs as analytes are highlighted in FIG. 42 with a black box around each group of similar vertical patterns. FIG. 43 shows the dendrogram of the vertical (analyte) blocking patterns in the matrix in FIG. 42. For the strictest definition of an epitope "bin" where only those mAbs which show identical blocking patterns technically bin together, there are a total of 4 discrete bins. Specifically, 33 of the 35 mAbs that were binned comprise two bins where the only difference between these two bins is whether a mAb sandwiches (Bin 2, see FIG. 42 and FIG. 43) with or blocks (Bin 1, see FIG. 42 and FIG. 43) binding to CPA.7.039. This means that CPA.7.039 is in its own separate bin. The fourth bin consists only of mAb CPA.7.050 which is unable to block antigen binding to any of the other 34 mAbs. Hierarchical clustering of the blocking patterns of the mAbs as ligands (horizontal patterns in FIG. 42) showed mAb CPA.7.016 sandwiching antigen with mAb CPA.7.039 whereas as an analyte it blocks antigen binding to immobilized CPA.7.039. Hence clone CPA.7.016 would be placed in bin 2 rather than in bin 1. The mAbs in each bind are listed in FIG. 43. Processed sensorgram data representative of each bin are shown in FIG. 44 to FIGS. 47A-47JJ.

Summary: 35 anti-PVRIG IgG mAbs were binned using SPR according to their pair-wise blocking patterns with fc fusion human PVRIG. By the strictest definition of an epitope bin, there are a total of four discrete bins. 33 of the 35 mAbs comprise two bins which differ only by whether their respective component mAbs block or sandwich antigen with clone CPA.7.039.

Example 12 Surface Plasmon Resonance Kinetic Screen of 50 Anti-PVRIG Human FABS Prepared in Periplasmic Extracts Materials and Methods All experiments were performed using a Biacore 3000 instrument and a ProteOn XPR 36 instrument at 22° C.

Step 1:

The molar concentration of all 52 fabs in periplasmic extract supernatant were quantitated using a Biacore 3000 instrument at 22° C. Each fab was diluted 20-fold and then injected for 2 minutes at 5 µL/min over high density anti-human fab (GE Healthcare 28-9583-25) surfaces prepared using standard amine coupling with a CM5 Biacore chip (GE Healthcare). A standard human fab at a known concentration (Bethyl P80-115) was then injected over the anti-fab surface with the same conditions as the fab supernatants. Samples were prepared in the running buffer which was degassed HBSP (0.01 M HEPES, 0.15 M NaCl, 0.005% P20, pH 7.4) with 0.01% BSA added. The association slopes of each SPR sensorgram from each fab supernatant was fit against the SPR association slope of the standard human fab of known concentration using CLAMP 3.40 software to estimate the molar concentrations of each fab in supernatant.

Step 2:

A high density goat anti-human fc polyclonal antibody surface (Invitrogen H10500) was prepared using standard amine coupling over two lanes of a GLC chip using a ProteOn XPR 36 biosensor. A high density anti-mouse fc polyclonal antibody surface (GE Healthcare BR-1008-38) was prepared using standard amine coupling over two different lanes of the same GLC chip. The activation and blocking steps for all four capture surfaces occurred in the vertical flow direction. Each fab in supernatant was then injected at three concentrations over fc-fusion human PVRIG (PVRIG-HH-2-1-1 #448, GenScript) and fc-fusion mouse PVRIG (PVRIG-MM-2-1-1 #198, GenScript) which were captured to one high density anti-human fc surface and one anti-mouse fc surface (respectively) at an average of ~200 RU and ~290 RU per cycle, respectively. Each fab concentration series was injected for two minutes followed by 10 minutes of dissociation at a flow rate of 50 µL/min. The starting concentration range (as determined in Step 1) was ~20 nM-~400 nM with two three-fold dilutions of the highest concentration for each fab. Fabs were diluted into the running buffer which was degassed PBS with 0.05% Tween 20 and 0.01% BSA added. The anti-human fc capture surfaces were regenerated with two 30-second pulses of 146 mM phosphoric acid after each cycle and the anti-mouse fc surfaces were regenerated with two 30-second pulses of 10 mM glycine, pH 1.7 after each cycle.

Step 3:

Sensorgram data of fabs in supernatant binding to captured PVRIG were processed and double-referenced using ProteOn Manager version 3.1.0.6. The sensorgrams were double-referenced using the corresponding anti-species capture surfaces with no captured PVRIG as reference surfaces and a blank injection over the captured PVRIG under identical conditions as the injections of the fabs. Where possible, the sensorgrams for the three different concentrations of each fab were then globally fit to a 1:1 kinetic model (with a term for mass transport) to estimate the association and dissociation rate constants. Sensorgrams which did not show simple 1:1 binding were not fit with the kinetic model and therefore were not assigned estimates for $k_a$ and $k_d$.

Results

Figures 50A, 50Q:
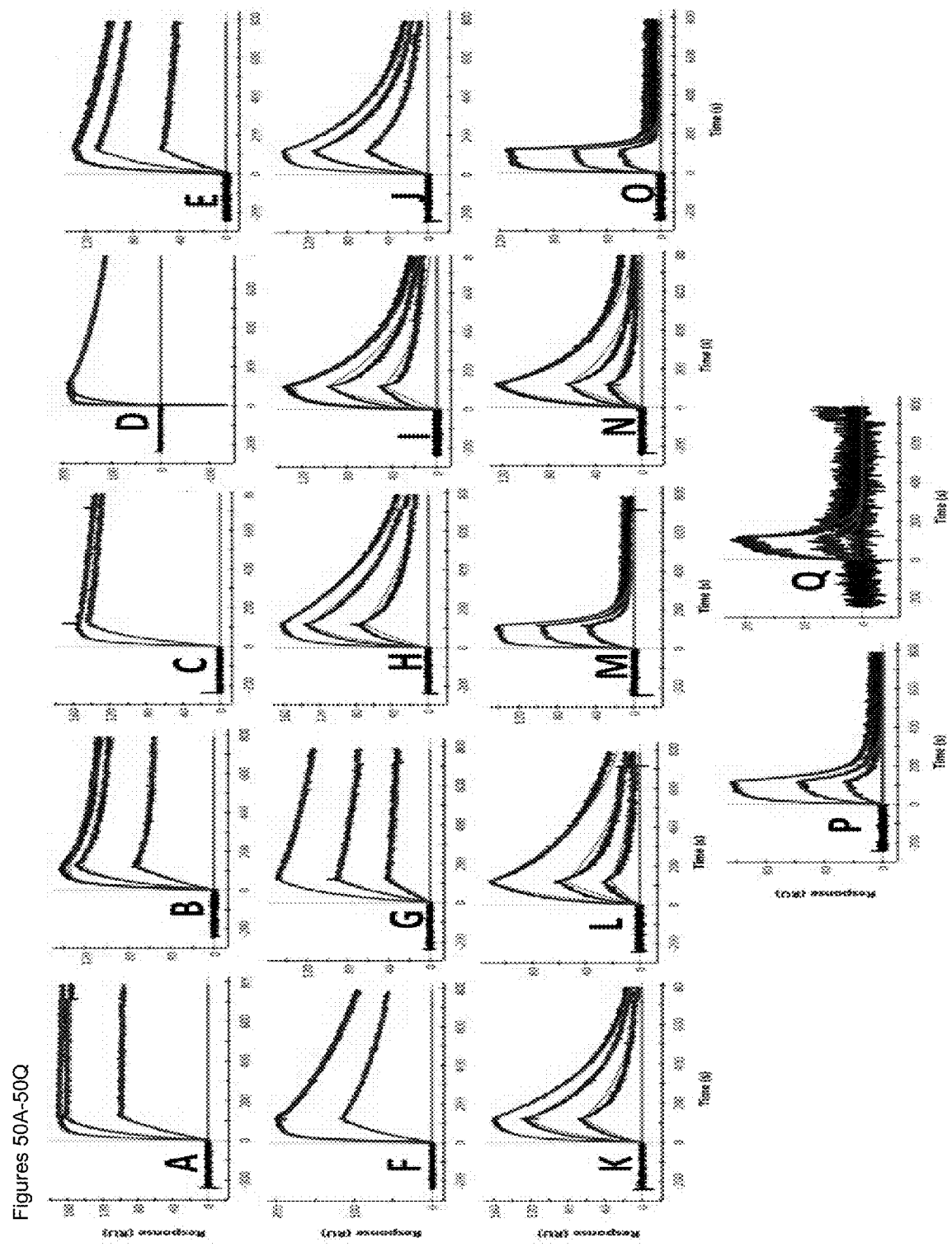
FIGS. 50A-50Q SPR sensorgram data of multiple concentrations of anti PVRIG fabs in supernatant injected over captured human PVRIG fusion protein (black lines). The red lines show the 1:1 global kinetic fit to multiple concentrations of the fabs to estimate the $k_a$ and $k_d$ of the interactions. Letters indicate the clone listed in Table 1, which also lists the resulting rate constants and calculated $K_D$ FIGS. 51A-51C SPR sensorgrams for clones CPA.7.009 (A), CPA.7.003 (B), and CPA.7.014 (C) binding to captured human PVRIG fusion protein. These are examples where the sensorgrams showed complex, multi-phasic kinetics and therefore the rate constants could not be reliably estimated.
Figures 51A, 51B, 51C:
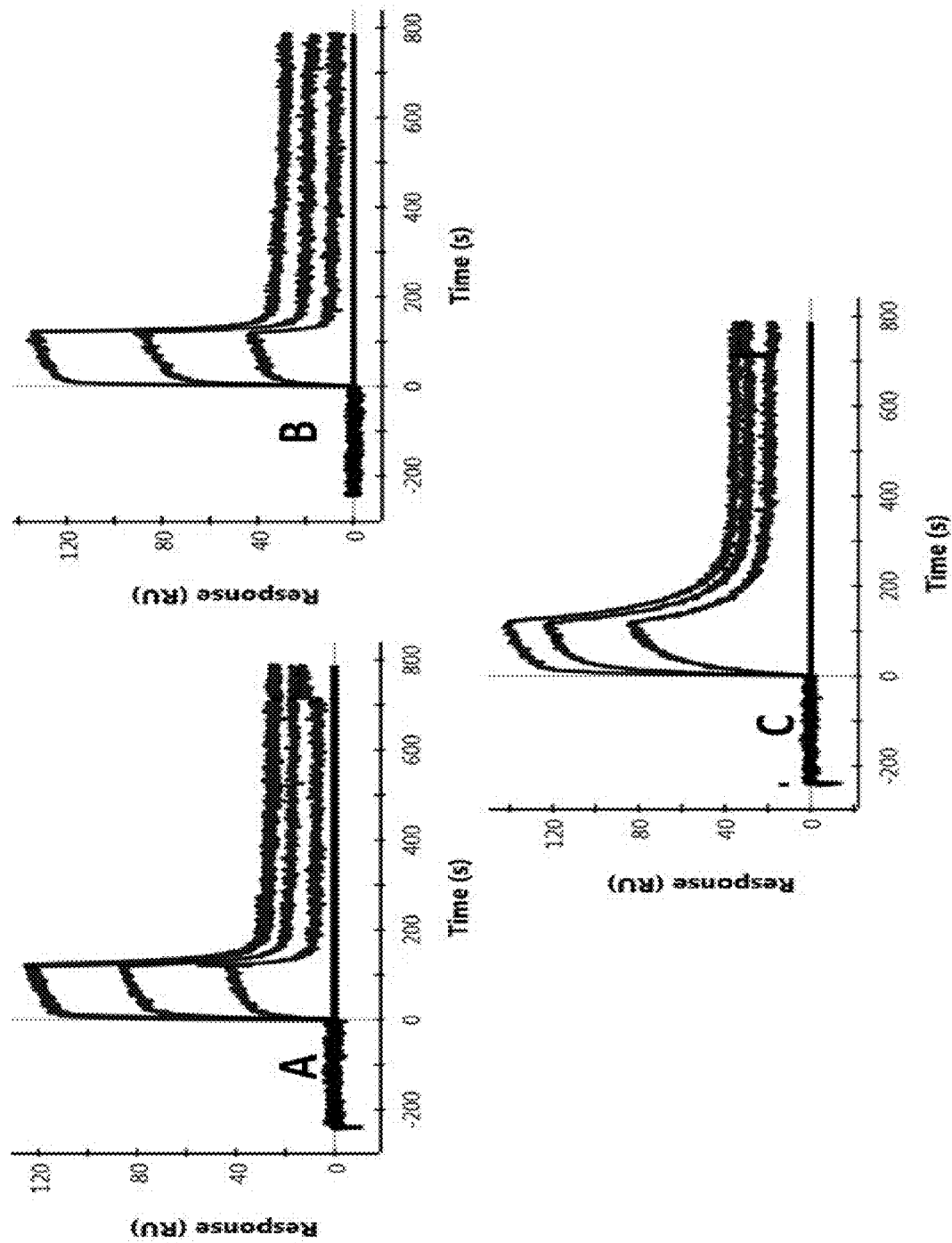
Figure 53:
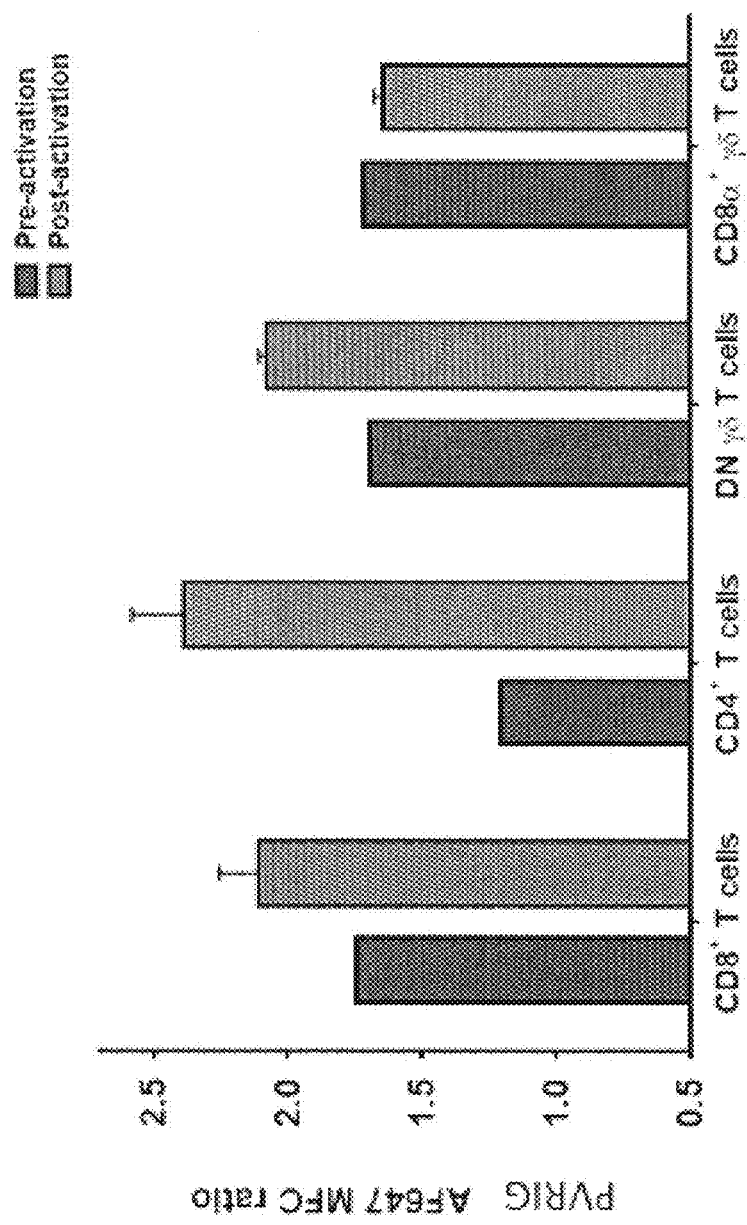
FIG. 53 shows that following allo-activation, the expression of PVRIG was upregulated on CD4+ T cells as well as on CD8+ T cells and double negative gamma delta T cells. This upregulation was observed in PBMCs of one out of two donors tested.

None of the fabs included in this study showed binding activity to mouse PVRIG (data not shown). Sensorgrams for 17 of the 50 fabs screened against the human PVRIG could be fit for reliable estimates of their rate constants. Twenty eight clones showed complex kinetics, five of the fabs did not show any binding to the captured human PVRIG fusion protein (CPA.7.025, CPA.7.026, CPA.7.027, CPA.7.029, CPA.7.035) and one clone (CPA.7.035) showed no titer when performing the concentration determination in Step 1. The rate constants and their corresponding sensorgrams are shown below in FIG. 49 and FIGS. 50A-50Q. The clones listed below showed complex kinetics. FIGS. 51A-51C show some examples of these data.

| CPA.7.001 | CPA.7.006 | CPA.7.013 | CPA.7.045 |
| CPA.7.030 | CPA.7.036 | CPA.7.014 | CPA.7.046 |
| CPA.7.031 | CPA.7.037 | CPA.7.041 | CPA.7.017 |
| CPA.7.032 | CPA.7.009 | CPA.7.042 | CPA.7.018 |
| CPA.7.033 | CPA.7.038 | CPA.7.043 | CPA.7.047 |
| CPA.7.034 | CPA.7.039 | CPA.7.016 | CPA.7.023 |
| CPA.7.003 | CPA.7.011 | CPA.7.044 | CPA.7.024 |

Example 13 Measuring The Binding Affinity of IGG Clone CPA.7.021 to PVRIG Expressed on HEK Cells Using Flow Cytometry Materials and Methods Flow cytometry was used to measure the affinity of CPA.7.021 IgG binding to human PVRIG expressed on HEK 293 cells. CPA.7.021 conjugated with Alexa 647 was added in duplicate at a binding site concentration range of 3 pM-101 nM in a 2-fold serial dilution to a constant number of cells (100,000 cells/well) over 17 wells in a 96-well plate. One well contained cells without any added IgG to serve as a blank well. The cells were equilibrated for 4 hours with IgG at 4° C. Cells were washed twice and then the Mean Fluorescence Intensity (MFI) was recorded over approximately 10,000 "events" using an Intellicyte flow cytometer. The resulting MFI values as a function of the CPA.7.021 IgG binding site concentration are shown below. The KD of CPA.7.021 binding to HEK 293 cells expressing human PVRIG was estimated by fitting the MFI vs. the IgG binding site concentration curve with a 1:1 equilibrium model as detailed in Drake and Klakamp, Journal of Immunol Methods, 318 (2007) 147-152.

Results: Alexa647 labelled CPA.7.021 IgG was titrated with HEK 293 cells expressing human PVRIG and the binding signal was measured using flow cytometry. The resulting binding isotherm, showing MFI in duplicate vs. the binding site concentration of CPA.7.021, is presented below. The red line is a 1:1 equilibrium fit of the curve that allows for a KD estimate of 2.5 nM±0.5 nM (95% confidence interval of the fit, N=1).

Example 14 Effect of PVRIG Knock Down (KD) and Anti-PVRIG Antibody on Human Melanoma Specific TILs Function The aim of these assays is to evaluate the functional capacity of PVRIG in human derived TILs, as measured by activation markers and cytokine secretion, upon co-culture with melanoma target cells. PD1 was used as a benchmark immune-checkpoint for the knock down (siRNA) studies. The effect of anti-PVRIG antibody (CPA.7.21), which has been shown to block the interaction of PVRIG and PVRL2, alone or in combination with other antibodies (e.g. aTIGIT, DNAM1) was evaluated.

Materials and Methods

TILs

Tumor-infiltrating lymphocytes (TILs) from three melanoma patients were used:

TIL-412-HLA-A2-Mart1 specific
TIL-F4-HLA-A2-gp100 specific
TIL-209-HLA-A2-gp100 specific TILs were thawed in IMDM (BI, 01-058-1A) full medium supplemented with 10% human serum (Sigma, H3667)+1% Glutamax (Life technologies, 35050-038)+1% Na-Pyruvate (Biological Industries, 03-042-1B)+1% non-essential amino acids (Biological Industries, 01-340-1B)+1% Pen-Strep (Biological Industries, 03-031-1B)+300 U/ml of rhIL2 (Biolegend, 509129).

Tumor Cell Lines:

Human melanoma cells Mel-624 express MART-1 and gp-100 antigens in the context of MHC-I haplotype HLA-A2. Cells were cultured in complete DMEM medium (Biological Industries, 01-055-1A) supplemented with 10% FBS (BI, 04-127-1A), 25 mM HEPES buffer (BI, 03-025-1B), 1% Glutamax (Life technologies, 35050-038), and 1% Pen-Strep (Biological Industries, 03-031-1B).

Knock Down in TILs:

Knock-down (KD) of human PVRIG and human PD1 in TILs was done using 100 pmol of Dharmacon ON-TARGETplus human PVRIG siRNA-SMARTpool (L-032703-02) or Human PD1 siRNA-SMARTpool (L-004435) or non-targeting siRNA (D-001810-01-05). siRNA were electroporated to TILs (AMAXA, program X-005). Electroporation was done on resting TILs cultured in full IMDM supplemented with IL-2 24 hr post thawing. After the electroporation TILs were seeded in 96 well TC plate to recover for 24 hr. After 24 hr, cells were harvested and stained with viability dye (BD Horizon; Cat#562247, BD biosciences), washed with PBS and stained with anti-human PVRIG-CPA.7.021 (CPA.7.021 IgG2 A647, 7.5 µg/ml) or with anti-human PD-1 (Biolegend, #329910 AF647, 5 µg/ml) in room temperature for 30 min. isotype control used are synagis (IgG2 A647, 7.5 µg/ml) and mouse IgG1 (Biolegend #400130 A647, 5 µg/ml) respectively. All samples were run on a MACSQuant analyzer (Miltenyi) and data was analyzed using FlowJo software (v10.0.8).

Co-Culture of TILs with 624 Melanoma Cells:

siRNA electroporated TILs were harvested and seeded in 96 TC plate 5×104/well. Mel-624 cells were harvested as well and seeded in 1:1/1:3 E:T ratios in co-culture. The plate was incubated overnight (18 hr) in 37° C., 5% CO2.

To assess the effect of anti-PVRIG antibody (CPA.7.021), anti-TIGIT (Clone 10A7) and anti-DNAM1 (clone DX11) on melanoma specific TIL activity, TILs ($1 \times 10^5$ cells/well) were pre-incubated with tested antibodies or relevant isotype controls in mono-treatment (10 μg/mL) or in combination-treatment (final 10 μg/mL for each) prior to the addition of 624 Melanoma target cells at a 1:1 Effector:target ratio. The plate was incubated overnight (18 hr) in 37° C., 5% CO2.

Assessment of TILs Activation:

16 hours post co-culture, cells were stained with viability dye (BD Horizon; Cat#562247, BD biosciences), washed with PBS and exposed to Fc blocking solution (cat#309804, Biolegend), followed by surface staining with anti-CD8a (Cat #301048, Biolegend) and anti-CD137 (Cat #309804, Biolegend) in 4° C. for 30 min. All samples were run on a MACSQuant analyzer (Miltenyi) and data was analyzed using FlowJo software (v10.0.8). Culture supernatants were collected and analyzed for cytokine secretion by CBA kit (Cat #560484, BD).

Results

Figure 82:
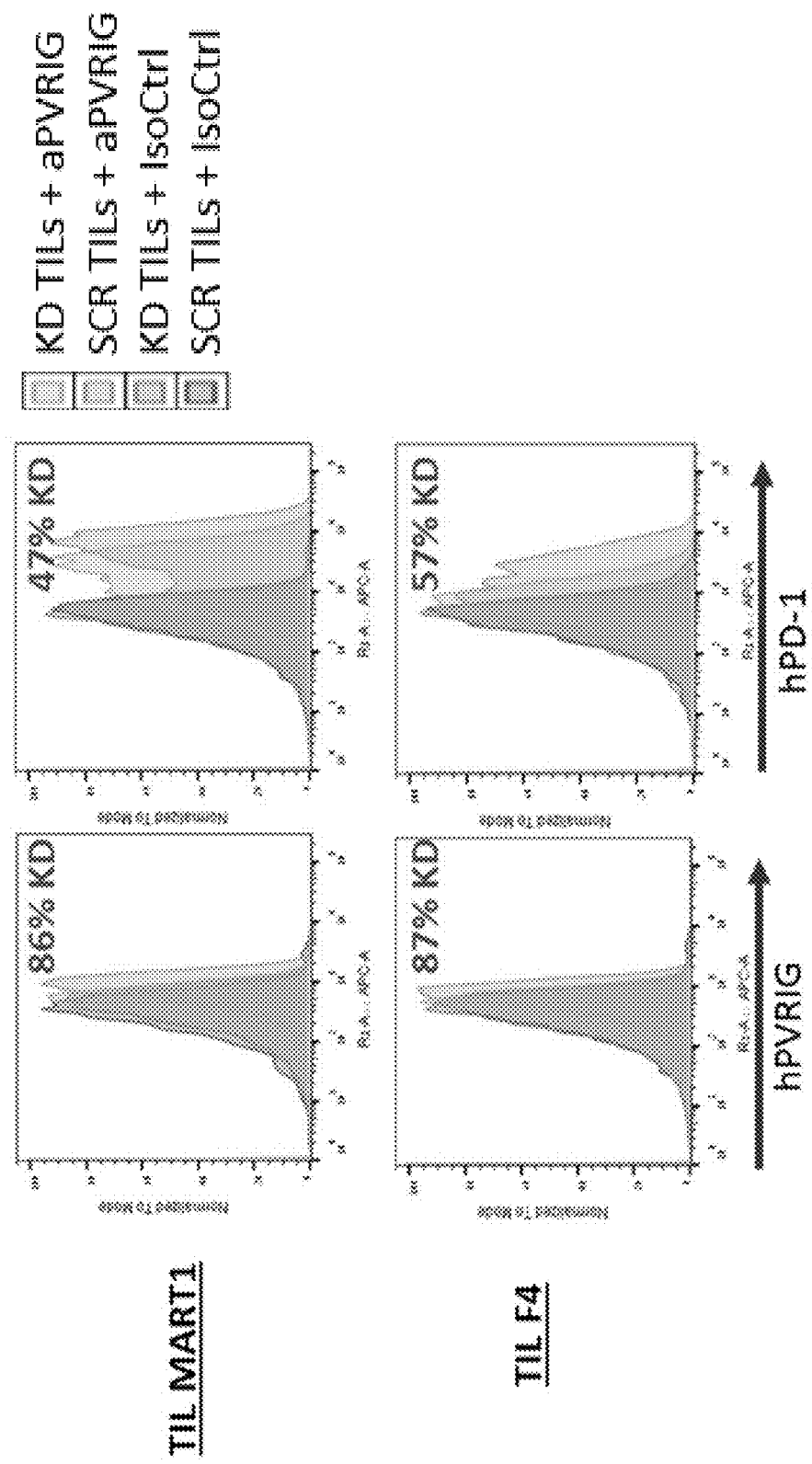
FIG. 82 KD validation performed in TILs 24 hr post-electroporation with siRNA. TILs were stained with anti PVRIG or anti PD-1 analyzed by FACS. Percentage of the KD population is calculated relative to SCR stained with the relevant Ab.

PVRIG Knock-Down in TILs:

TIL MART-1 and TIL F4 were cultured 24 hr with IL-2. 100 pmol of ON-TARGETplus human PVRIG siRNA-SMART pool (L-032703-02) or Human PD1 siRNA-SMARTpool (L-004435) or non-targeting siRNA (D-001810-01-05) were electroporated to TILs (AMAXA, program X-005). Detection of PVRIG or PD-1 was performed 24 hr post electroporation (and prior to co-culture). Cells were stained for viability dye followed by 30 min RT incubation with anti PVRIG or anti PD-1. The percentage of KD population is indicated in FIG. 82.

Functional Assay Using Knocked Down TILs:

Human TILs, cultured for 24 hours with IL2 were electroporated with siRNA encoding for human PVRIG or PD-1 or scrambled sequence as control. TILs were tested for PVRIG and PD-1 expression 24 hr post electroporation. ~80% knock down of PVRIG and ~50% knock down of PD-1 compared to scrambled-electroporated TILs was observed (FIG. 82).

Figure 83A:
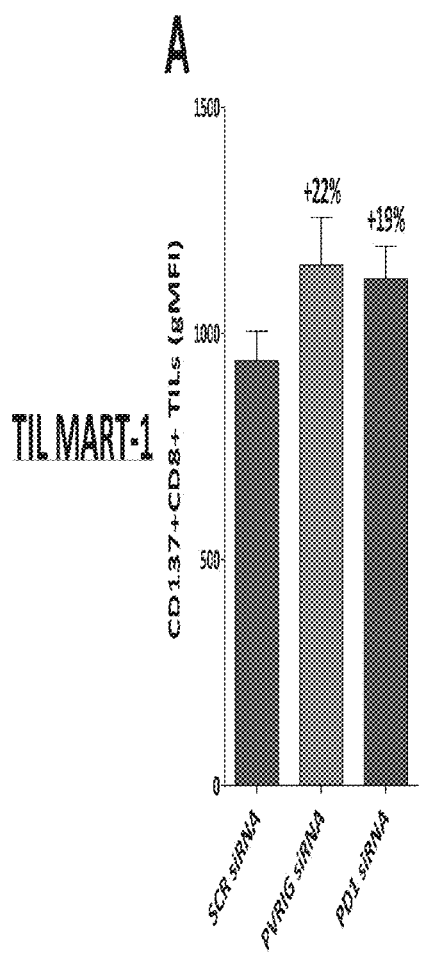
FIG. 83A-83C KD TILs (MART-1 specific) were co-cultured with melanoma cells 624 in 1:1 E:T for 18 hr and stained with anti CD8a antibody as well as anti CD137 antibody and analyzed by FACS. Geometric mean fluorescence intensity are plotted (A). Co-culture supernatant was collected as well and tested in Th1 Th2 Th17 cytometric bead array assay to detect secreted cytokines. IFNγ and TNF levels were detected (B,C). The percentage effect of a treatment is calculated by comparing each treatment to SCR control. The figure shows representative data of 2 independent experiments. Treatments were compared by Student's t-test (*P≤0.05, **P≤0.01) of triplicate samples.
Figure 83B:
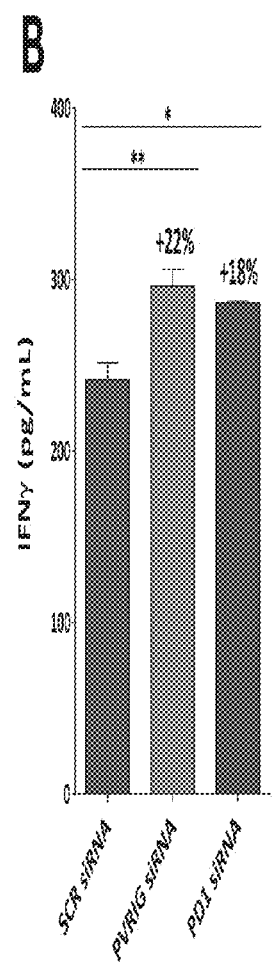
Figure 83C:
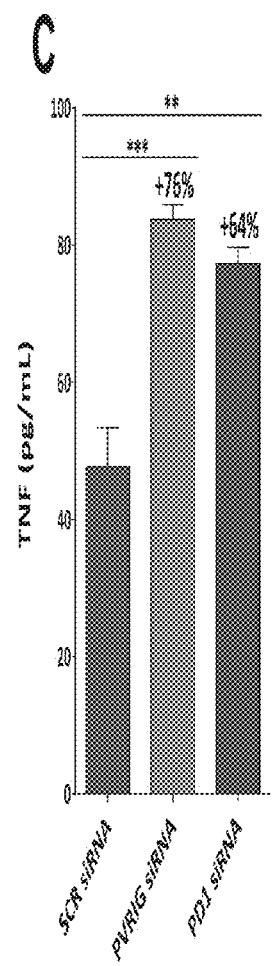

KD TILs were cultured with Mel-624 cells in 1:1 or 1:3 E:T for 18 hr and were stained for the expression of CD137. Elevated levels of activation marker CD137 were shown in TIL MART-1 electroporated with PVRIG siRNA, similarly to TILs that were electroporated with PD-1 siRNA, compared to control scrambled siRNA (FIG. 83A). Co-culture supernatant was collected and tested for the presence of secreted cytokines. TILs that were electroporated with PVRIG siRNA show a significant increase in IFNγ and TNF levels compared to control SCR siRNA. A similar effect was shown in TILs that were electroporated with PD-1 siRNA (FIG. 83B-83C).

Figure 84A:
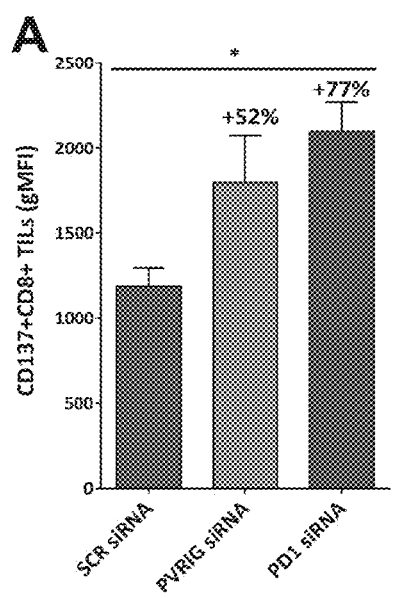
FIGS. 84A-84B KD TILs (F4 gp100 specific) were co-cultured with melanoma cells 624 in 1:3 E:T for 18 hr and stained with anti CD8a antibody as well as anti CD137 antibody and analyzed by FACS. Geometric mean fluorescence intensity are plotted (A). Co-culture supernatant was collected as well and tested in Th1 Th2 Th17 cytometric bead array assay to detect secreted cytokines. IFNγ levels were detected (B). Percentage of the effect a treatment has is calculated by comparing each treatment to SCR control. Figure shows representative data of 2 independent experiments. Treatments were compared by Student's t-test (*P≤0.05, **P≤0.01) of triplicate samples.
Figure 84B:
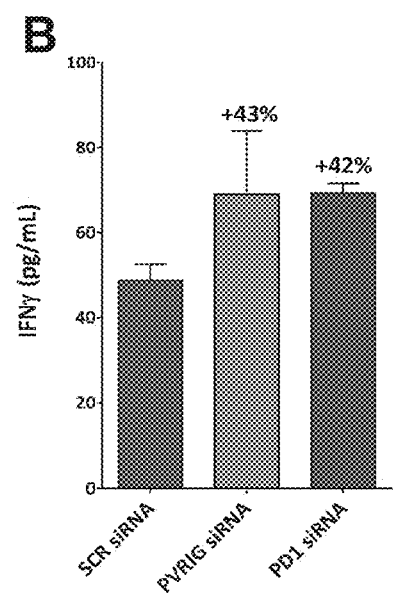

The same trend of increase in activation levels was observed in TIL F4. Co-culture of PVRIG siRNA electroporated TIL F4 with Mel-624 in 1:3 E:T led to increased levels of CD137 surface expression (FIG. 84A) as well as increased secretion of IFNγ in co-culture supernatant (FIG. 84B). Similar trends were observed in TILs that were electroporated with PD-1 siRNA.

Figures 85A, 85B:
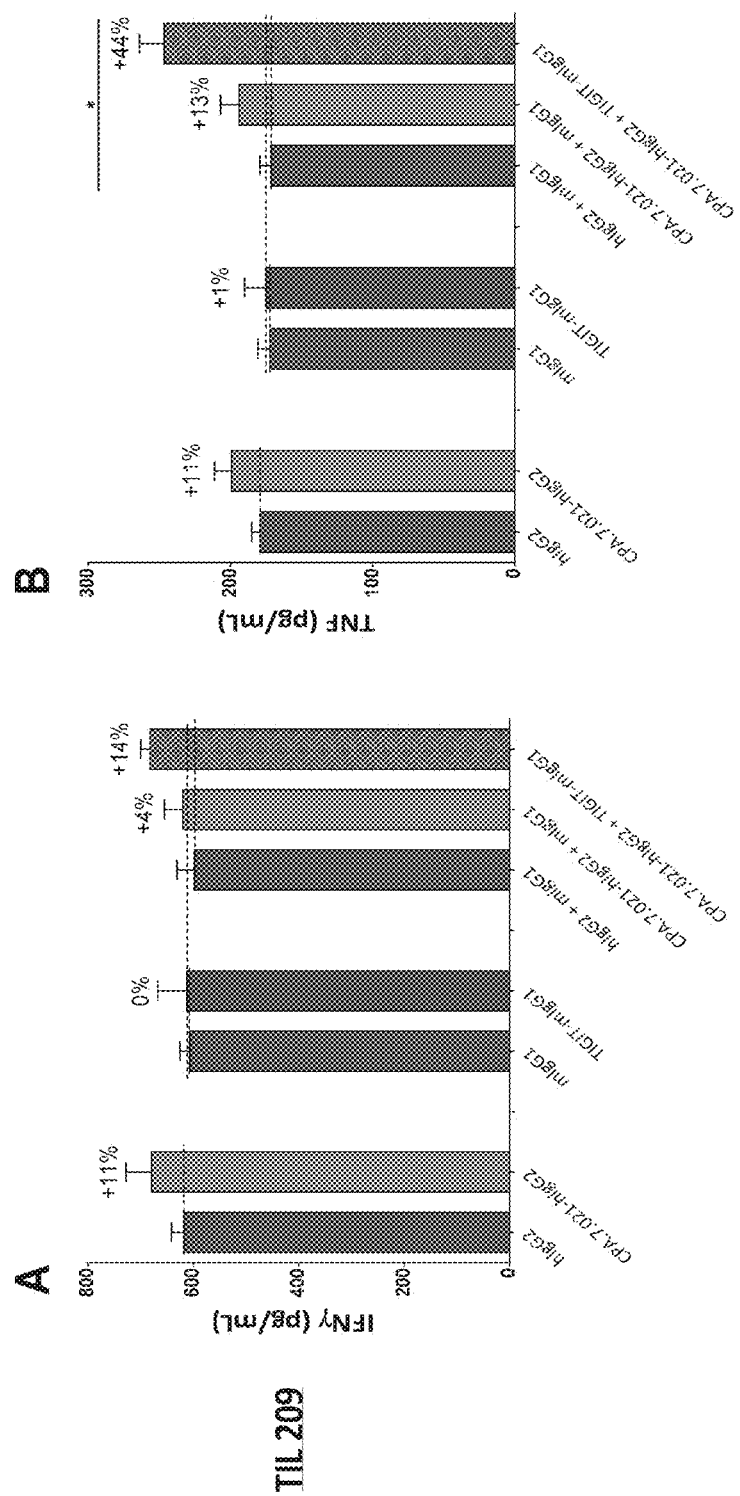
FIGS. 85A-85B TILs from were co-cultured with melanoma cells 624 at 1:1 E:T for 18 hr in the presence of anti-PVRIG Ab (CPA.7.021; 10 μg/ml), anti-TIGIT (10A7 clone; 10 μg/ml) or in combination. Supernatant was collected and tested in Th1 Th2 Th17 cytometric bead array assay to detect secreted cytokines. IFNγ (A) and TNF (B) levels were detected. Treatments were compared by Student's t-test (*P≤0.05, **P≤0.01) of triplicate samples.

Functional Assay Using Blocking Abs:

In Vitro Monotherapy and Combo Therapy of Anti-PVRIG and Anti-TIGIT:

209 TILs were cultured with Mel-624 cells in 1:1 E:T for 18 hr. Co-culture supernatant was collected and tested for the presence of secreted cytokines. Treatment with anti TIGIT did not affect IFNγ or TNF secretion levels. However, an increase in IFNγ and TNF levels was observed when anti TIGIT and anti PVRIG were added to co-culture in combination (FIGS. 85A-85B).

In Vitro Monotherapy and Combo Therapy of Anti-PVRIG and Anti-TIGIT:

209 TILs were cultured with Mel-624 cells in 1:1 E:T for 18 hr. TILs were stained for surface expression of activation marker CD137 and showed reduced level of expression upon treatment with anti DNAM-1. Co-culture supernatant was collected and tested for presence of secreted cytokines. Treatment of anti DNAM-1 mediated a trend to increase secreted cytokines IFNγ and TNF. Treatment with anti DNAM-1 and anti PVRIG in combination partially reversed the effect on CD137 expression (FIG. 86C) and enhanced the effect on cytokine secretion IFNγ and TNF (FIG. 5A-B). MART-1 TILs were cultured with Mel-624 cells in 1:1 E:T for 18 hr. Co-culture supernatant was collected and tested for the presence of secreted cytokines. Treatment with anti DNAM-1 reduced CD137 surface expression on TILs and also the secreted cytokines IFNγ and TNF. Treatment with anti DNAM-1 and anti PVRIG in combination partially reversed these effects (FIGS. 86D-86F).

Summary and Conclusions

PD1 KD improved TIL activity, as measured by IFNγ and secretion in F4 and MART-1 TILs. An increase (~20%) of IFNγ and TNF secretion was observed upon PVRIG KD in MART-1 TILs compared to control siRNA. The same trend was observed in CD137 expression upon co-culture with 624 Melanoma cells on F4 TILs.

Treatment of anti-TIGIT did not affect IFNγ or TNF secretion levels from TILs co-cultured with 624 Mels, however, an increase in IFNγ and TNF levels was observed when anti TIGIT and anti PVRIG (CPA.7.021) were added to co-culture in combination.

Anti DNAM-1 treatment reduced TIL-MART-1 activation manifested by reduced CD137 and cytokine secretion and anti-PVRIG (CPA.7.21) could partially reverse this effect in combo treatment with DNAM-1 Ab. In TIL 209, IFNγ and TNF secretion levels were slightly elevated (~10%) with anti DNAM-1, and an increase in IFNγ and TNF levels (~40% and 30%, respectively) was observed when anti DNAM1 and anti PVRIG (CPA.7.021) were added to co-culture in combination. Collectively, our results suggest that PVRIG is a new co-inhibitory receptor for PVRL2.

Example 15 Effect of Anti-PVRIG Antibody on Human Melanoma Specific TILS Function in Combination with Anti-TIGIT and Anti-PD1 Antibodies Materials and Methods TILs: Tumor-infiltrating lymphocytes (TILs) from three melanoma patients were used:

1. TIL-412-HLA-A2-Mart1 specific
2. TIL-F4-HLA-A2-gp100 specific
3. TIL-209-HLA-A2-gp100 specific TILs were thawed in IMDM (BI, 01-058-1A) full medium supplemented with 10% human serum (Sigma, H3667)+1% Glutamax (Life technologies, 35050-038)+1% Na-Pyruvate (Biological Industries, 03-042-1B)+1% non-essential amino acids (Biological Industries, 01-340-1B)+1% Pen-Strep (Biological Industries, 03-031-1B)+300 U/ml of rhIL2 (Biolegend, 509129).

Tumor Cell Lines:

Human melanoma cells Mel-624 express MART-1 and gp-100 antigens in the context of MHC-I haplotype HLA-A2. Cells were cultured in complete DMEM medium (Biological Industries, 01-055-1A) supplemented with 10% FBS (BI, 04-127-1A), 25 mM HEPES buffer (BI, 03-025-1B), 1% Glutamax (Life technologies, 35050-038), and 1% Pen-Strep (Biological Industries, 03-031-1B).

Co-Culture of TILs with 624 Melanoma Cells in the Presense of Anti-PVRIG, Anti-TIGIT and PD1 Blocking Antibodies:

To assess the effect of anti-PVRIG antibody (CPA.7.021), anti-TIGIT (Clone 10A7) and anti-PD1 (mAb 1B8, Merck) on melanoma specific TIL activity, TILs (3×104 cells/well) were pre-incubated with tested antibodies or relevant isotype controls in mono-treatment (10 µg/mL) or in combination-treatment (final 10 µg/mL for each) prior to addition of 624 Melanoma target cells at 1:3 Effector:target ratio. Plate was incubated overnight (18 hr) in 37° C., 5% CO2.

Assessment of TILs Activation:

Culture supernatants were collected and analyzed for cytokine secretion by CBA kit (Cat #560484, BD).

In Vitro Monotherapy Anti-PVRIG and Combo-Therapy of with Anti-TIGIT and PD1 Blocking Antibodies:

F4 TILs (gp100 specific) were cultured with Mel-624 cells in 1:3 E:T for 18 hr. Co-culture supernatant was collected and tested for presence of secreted cytokines. Treatment of anti-TIGIT or anti-PD1 did not affect IFNγ or TNF secretion levels. However, an increase in IFNγ and TNF levels was observed when anti TIGIT or anti-PD1 in combination with anti PVRIG were added to co-culture in combination (FIGS. 87A-87B).

Treatment of anti-PVRIG, anti-TIGIT and PD1 alone did not affect IFNγ or TNF secretion levels from TILs co-culture with 624 Mels, however, an increase in IFNγ and TNF levels was observed when anti-TIGIT or anti-PD1 antibodies were added in combination with anti PVRIG (CPA.7.021). The presented data suggest that there is synergestic effect for combinatory therapy with anti-TIGIT or anti-PD1 antibodies.

Example 16: Effect of Anti-PVRIG Antibodies on TCR Signaling Using Reporter Gene Assay A reporter assay system for TCR signaling, such as the Jurkat-NFAT-Luc cell line, is used to test the effect of anti-PVRIG antibodies on TCR mediated signaling. This Jurkat cell line derivative expresses the luciferase reporter gene under the control of the NFAT response element. These cells are transfected with a vector encoding full length human PVRIG. As negative control, cells transfected with empty vector are used. Transfectants with vectors encoding for costimulatory or coinhibitory reference molecules, such as CD28 and PD-1, serve as positive control. Transfectants are stimulated by the addition of anti-human CD3 (e.g. OKT3) in the absence or presence of anti-PVRIG antibodies. Isotype control serves as negative control. Known functional antibodies against the reference molecules serve as positive controls. A functional agonistic crosslinking antibody is expected to show an inhibitory effect on the luciferase activity.

Example 17 Effect of Anti-PVRIG Antibodies on T Cell Activation Using PVRL2-FC

A plate bound assay is used to test the effect of anti-PVRIG antibodies on T cell activation, proliferation and cytokine secretion. Purified human bulk T cells are stimulated using 1 µg/ml plate bound anti-human CD3 (e.g. OKT3) and 5 µg/ml PVRL2-Fc (recombinant fused protein composed of the ECD of PVRL2, the counterpart of PVRIG) or negative control. T cell activation is evaluated by expression of activation markers, e.g. CD137, or by cell division as evaluated by dilution of CFSE dye (T cells are labeled with CFSE prior to their stimulation). Cytokine production (e.g. IFNg, IL-2) is also assessed as additional readout of T cell activation. T cell subtype markers are used to distinguish specific effects on CD4 or CD8 T cells. The co-immobilized PVRL2-Fc could have a basal stimulatory effect on T cell activation, mediated through endogenous DNAM1—a known costimulatory counterpart receptor of PVRL2 on T cells. In the presence of antagonistic anti-PVRIG Abs, this stimulatory basal effect of PVRL2-Fc is expected to be further enhanced, due to their blocking of the inhibitory influence of endogenous PVRIG on T cell activation. Accordingly, agonistic anti-PVRIG Abs are expected to show inhibition of T cell activation.

Example 18: Effect of Anti-PVRIG Antibodies on T Cell Activation Using PVRL2 Ectopic Expressing Cells A cell based assay is used to test the effect of anti-PVRIG antibodies on T cell activation, proliferation and cytokine secretion. Purified human bulk or CD4 or CD8 T cells are stimulated upon co-culture with CHO stimulator cells (CHO cells expressing membrane-bound anti-CD3) ectopically expressing PVRL2 or empty vector. T cell activation is evaluated by expression of activation markers, e.g. CD137, or by cell division as evaluated by dilution of CFSE dye (T cells are labeled with CFSE prior to their stimulation). Cytokine production (e.g. IFNγ, IL-2) is also assessed as additional readout of T cell activation. T cell subtype markers are used to distinguish specific effects on CD4 or CD8 T cells. The PVRL2-expressing CHO stimulators are expected to have a basal Example 19 stimulatory effect on T cell activation, mediated through endogenous DNAM1—a known costimulatory counterpart receptor of PVRL2 on T cells. In the presence of antagonistic anti-PVRIG Abs, this stimulatory basal effect of surface expressed PVRL2 is expected to be further enhanced, due to their blocking of the inhibitory influence of endogenous PVRIG on T cell activation. Accordingly, agonistic anti-PVRIG Abs are expected to show inhibition of T cell activation.

Example 20 Effect of Anti-PVRIG Antibodies on T Cell Activation Using the SEB Assay Anti-PVRIG antibodies are tested for their effect on T cell activity using blood cells from healthy volunteers and SEB (Staphylococcus enterotoxin B) superantigen to engage and activate all T cells expressing the Vβ3 and Vβ8 T cell receptor chain. Human PBMCs are cultured in 96-well round-bottom plates and pre-incubated for 30-60 min with the tested antibodies. SEB is then added at various concentrations ranging from 10 ng/mL to 10 µg/mL. Supernatants are collected after 2 to 4 days of culture and the amount of cytokine (e.g. IL-2, IFNγ) produced is quantified by ELISA or using standard CBA kit. SEB stimulates cytokine production by whole-blood cells in a dose dependent manner. The effect of anti-PVRIG mAbs on cytokine production is tested at several Ab doses. Blocking anti-PVRIG mAbs are expected to enhance IL-2 production over control IgG. In addition to IL-2, the effect of the Abs on the levels of additional cytokines such as TNFα, IL-17, IL-7, IL-6 and IFNγ can be tested in this assay using a CBA kit.

Example 21; Effect of Anti-PVRIG Antibodies in Ag-Specific Assays

An assay that is used to profile the functional effect of anti-human PVRIG antibodies on Ag specific stimulation of pre-existing memory T cells in healthy donor blood is the tetanus toxoid (TT) assay. To this end, freshly prepared PBMC ($2 \times 10^5$ cells) are plated in 96 well round-bottom plates in complete RPMI 1640 medium (containing 5% heat inactivated human serum), pre-incubated with tested antibodies at varying concentration and stimulated with TT (Astarte Biologics) at a concentration of 100 ng/mL The cells are incubated for 3-7 days at 37° C., after which supernatants are harvested. Cytokine concentrations (e.g. IL-2, IFN-γ) are determined by ELISA and/or CBA kit. Blocking anti-PVRIG Abs are expected to enhance T cell proliferation and cytokine production compared to that obtained with TT antigen alone.

Similarly to the method described above, which uses TT to stimulate human memory T cells, we can test the effect of anti-PVRIG Abs on T cell activation upon recall responses to additional antigens such as CMV, EBV, influenza HIV, mumps, and TB, using a similar experimental setup as described above. This can also be used to test the effect of anti-PVRIG antibodies on stimulation of naïve cells using neo-antigens such as KLH.

In addition, the effect of anti-PVRIG Abs is tested on the antigen specific responses of tetramer-sorted Ag-specific CD8 T cells from peripheral blood of patients suffering from viral infections such as HCV and HIV. Tetramer sorted CD8 T cells are co-cultured with peptide-loaded autologous PBMCs for 5 days. Proliferation of CD8 Ag-specific T cells and secretion of cytokines (e.g. IFNγ, IL2, TNF-α) are evaluated. We expect anti-PVRIG antibodies to enhance proliferation and cytokine production, compared to antigen alone.

Example 22 Binding and Functional Analysis of Hybridoma-Derived Antibodies Against PVRIG This example shows the characterization of binding of hybridoma-derived antibodies (the CHA antibodies) to human and cynomolgus PVRIG protein in cell lines and primary leukocytes, as well as the characterization of the capacity of hybridoma-derived antibodies to block the interaction between PVRIG and PVRL2.

Protocols

FACS Analysis of hPVRIG Over-Expressing Cells:

The following cell lines were used to assess the specificity of anti-human PVRIG antibodies: HEK parental and HEK hPVRIG over-expressing cells. These cells were cultured in DMEM (Gibco)+10% fetal calf serum (Gibco)+glutamax (Gibco). For the HEK hPVRIG over-expressing cells, 0.5 µg/ml puromycin (Gibco) was also added to the media for positive selection. For FACS analysis, all cell lines were harvested in log phase growth and 50,000-100,000 cells per well were seeded in 96 well plates. Anti-human PVRIG antibodies (mIgG1 or mIgG2a) and their respective controls were added in single point dilutions (5 µg/ml), or as an 8 point titration series starting at 10 µg/ml on ice for 30 mins-1 hr. The titration series were conducted as either 1:3 or 1:3.3 fold serial dilutions. Data was acquired using a FACS Canto II (BD Biosciences) or IntelliCyt (IntelliCyt Corporation) and analyzed using FlowJo (Treestar) and Prism (Graphpad) software.

FACS Analysis of Human Cell Lines for hPVRIG:

The following cell lines were used to assess the expression and specificity of anti-human PVRIG antibodies: Jurkat and HepG2. Jurkat cells were cultured in RPMI media+10% fetal calf serum, glutamax, non-essential amino acids (Gibco), sodium pyruvate (Gibco), and penicillin/streptomycin (Gibco). HepG2 cells were cultured in DMEM+10% fetal calf serum+glutamax. For FACS analysis, all cell lines were harvested in log phase growth and 50,000-100,000 cells per well were seeded in 96 well plates. Anti-human PVRIG antibodies (mIgG1 or mIgG2a) and their respective controls were added in single point dilutions (5 µg/ml), or as an 8 point titration series starting at 10 µg/ml on ice for 30 mins-1 hr. The titration series were conducted as either 1:3 or 1:3.3 fold serial dilutions. Data was acquired using a FACS Canto II or IntelliCyte and analyzed using FlowJo and Prism software.

FACS Analysis of Naïve Human Primary Leukocytes for hPVRIG:

Primary leukocytes were obtained by Ficoll (GE Healthcare) gradient isolation of peripheral blood (Stanford Blood Bank). Leukocytes as isolated peripheral blood mononuclear cells (PBMC) were frozen down in liquid nitrogen at a density between $1 \times 10^7$ and $5 \times 10^7$ cells/ml in a 10% DMSO (Sigma), 90% fetal calf serum mixture. To assess protein expression of PVRIG on PBMC, antibody cocktails towards major immune subsets were designed that included human anti-PVRIG antibodies. Anti-human PVRIG antibodies (mIgG1 or mIgG2a) and their respective controls were added in single point dilutions (5 µg/ml), or in some cases, as a 4 point titration series starting at 10 µg/ml on ice for 30 mins-1 hr.

Briefly, antibody cocktail mixtures were added to resuscitated PBMC that were seeded at $5 \times 10^5$-$1 \times 10^6$ cells/well upon prior Fc receptor blockade and live/dead staining (Aqua Live/Dead, Life Technologies). Antibody cocktails were incubated with PBMC for 30 mins-1 hr on ice. PBMC were then washed and data was acquired by FACS using a FACS Canto II. Data was analysed using FlowJo and Prism software. Immune subsets that were analysed include CD56 dim NK cells, CD56 bright NK cells, CD4+ T cells, CD8+ T cells, non-conventional T cells (e.g. NKT cells and γδ T cells), B cells, and monocytes.

FACS Analysis of Cynomolgus PVRIG Engineered Over-Expressing Cells:

The following cell lines were used to assess the cross-reactivity of anti-human PVRIG antibodies with cynomolgus PVRIG (cPVRIG): expi parental and expi cPVRIG over-expressing cells. These cells were cultured in DMEM+10% fetal calf serum+glutamax. expi cPVRIG transient over-expressing cells were generated by electroporating cPVRIG DNA into parental expi cells using the Neon transfection system. For FACS analysis, expi cPVRIG cells were used between 1-3 days post transfection. Parental expi cells were harvested from log growth phase. 50,000-100,000 cells of per well of each type were seeded in 96 well plates. Anti-human PVRIG antibodies (mIgG1 or mIgG2a) and their respective controls were added in single point dilutions (5 µg/ml), or as an 8 point titration series starting at 10 µg/ml on ice for 30 mins-1 hr. The titration series were conducted as either 1:3 or 1:3.3 fold serial dilutions. Data was acquired using a FACS Canto II or IntelliCyte and analyzed using FlowJo and Prism software.

FACS Analysis of Naïve Primary Cynomolgus Monkey Leukocytes:

Primary cynomolgus monkey (cyno) leukocytes were obtained from fresh blood which was drawn no longer than 24 hours prior to expression analysis. Blood was sourced from Bioreclamation. To assess protein expression of PVRIG on cyno PBMC, antibody cocktails towards major immune subsets were designed that included human anti-PVRIG antibodies. Anti-human PVRIG antibodies (mIgG1 or mIgG2a) and their respective controls were added in single point dilutions (5 μg/ml), or as an 8 point titration series starting at 10 μg/ml on ice for 30 mins-1 hr.

Briefly, antibody cocktail mixtures were added to PBMC that were seeded at $5\times10^5$-$1\times10^6$ cells/well upon prior Fc receptor blockade and live/dead staining. Antibody cocktails were incubated with PBMC for 30 mins-1 hr on ice. PBMC were then washed and data was acquired by FACS using a FACS Canto II. Data was analysed using Prism software. Immune subsets that were analysed include CD16+ lymphocytes, CD14+/CD56+ monocytes/myeloid cells, and CD3+ T cells.

Cellular-Based Competition Assays:

The ability of PVRIG antibodies to inhibit the interaction of PVRIG with its ligand PVRL2 was assessed in a cellular competition assay. In this assay, the ligand PVRL2 is endogenously expressed on un-manipulated HEK cells and soluble Fc-tagged PVRIG (manufactured on demand by Genscript) is added. In this case, the ability of PVRIG antibodies to block soluble PVRIG binding to HEK cells were assessed through the concomitant addition of 33 nM of soluble PVRIG protein and PVRIG antibodies (0.066-66 nM) to 100,000 HEK cells and incubated for 1 hour on ice. The extent of PVRIG Fc binding was detected by addition of anti-human Fc Alexa 647 (Jackson Laboratories) for 20-30 minutes on ice. Cells were washed twice in PBS for acquisition using a FACS Canto II. Data was analyzed using FlowJo (Treestar), Excel (Microsoft) and Prism (GraphPad).

Results

Figure 77:
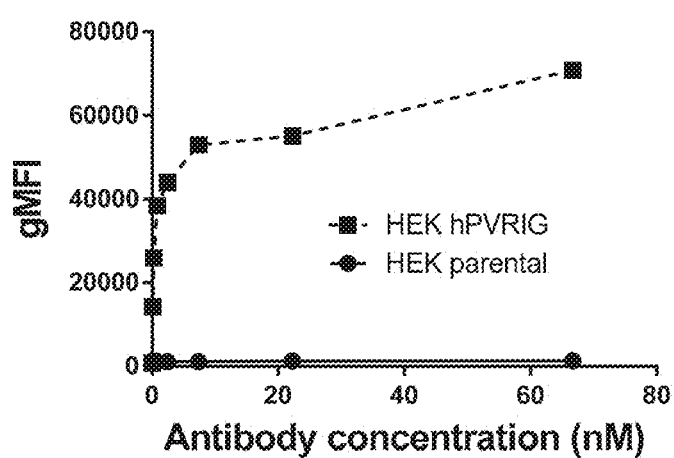
FIG. 77 PVRIG antibody specificity towards HEK cells engineered to overexpress PVRIG. Data shows absolute geometric MFI (gMFI) measurements as a function of increasing antibody concentration. The broken black line with squares shows staining of HEK hPVRIG cells with a representative anti-human PVRIG antibody (CHA.7.518), and the solid black line with circles shows staining of HEK parental cells with the same antibody.

Hybridoma PVRIG antibodies recognize PVRIG on over-expressing cells: To screen for antibodies that were specific for PVRIG, we assessed the ability of antibodies that were generated from two hybridoma campaigns to bind HEK cell lines that were engineered to overexpress human PVRIG. The majority of antibodies from these campaigns bound to the HEK hPVRIG cells, albeit with varying affinity. Furthermore, the majority of these antibodies also showed low background binding to HEK parental cell lines indicating high specificity towards PVRIG. FIG. 77 shows one example of the specificity of the PVRIG antibodies. A summary of all binding characteristics of the antibodies towards HEK hPVRIG cells relative to control that were generated in the hybridoma campaigns are displayed in FIGS. 79A-79B.

PVRIG Antibodies Recognize PVRIG Protein on Naïve NK and T Cells:

The populations which displayed the highest level of PVRIG on naïve PBMC subsets were NK and CD8 T cells, and the absolute level of expression between these two cell subsets was similar (gMFI). CD4 T cells showed lower levels of PVRIG, while B cells and monocytes had very low/no detectable expression. A summary of expression on naïve NK cells and CD8 T cells as detected by the antibodies is shown in FIG. 91. Other minor subsets also displayed PVRIG expression and included non-conventional T cells such as NKT cells and γδ T cells. The expression pattern on PBMC subsets was very similar across all donors sourced and analyzed.

PVRIG is Detected on Jurkat Cell Lines by Hybridoma-Derived PVRIG Antibodies:

In addition to screening PBMC for PVRIG protein expression, we wanted to understand whether it was also expressed on cancer cell lines. We chose to screen our antibodies on Jurkat cells given their high expression of PVRIG RNA. We also chose HepG2 as a negative control cell line to further validate the specificity of our antibodies. Most of the hybridoma-derived antibodies did detect PVRIG protein expression on Jurkat cells (FIGS. 79A-79B PVRIG hybridoma antibody binding characteristics to primary human PBMC, cyno over-expressing cells, and cyno primary PBMC. Expi cyno OE denotes expi cells transiently transfected with cPVRIG, expi par denotes expi parental cells. gMFIr indicates the fold difference in geometric MFI of PVRIG antibody staining relative to their controls. Concentrations indicate that at which the gMFIr was calculated. Not tested indicates antibodies that were not tested due to an absence of binding to human HEK hPVRIG, expi cPVRIG cells, or not meeting binding requirements to PBMC subsets. Highlighted antibodies are four antibodies for which humanization was done (See FIG. 90).

Figure 78:
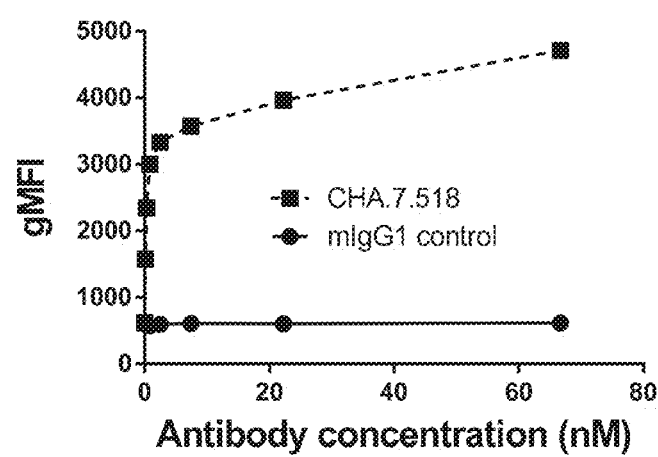
FIG. 78 PVRIG antibodies show specificity towards Jurkat cells. Data shows absolute geometric MFI (gMFI) measurements by FACS as a function of increasing antibody concentration. The broken black line with squares shows staining of Jurkat cells with anti-human PVRIG antibody (CHA.7.518) and the solid black line with circles shows staining with an mIgG1 control antibody.

FIG. 92), but not the HepG2 cells (data not shown). An example of PVRIG detection on Jurkat is shown in FIG. 78 with a representative antibody, CHA.7.518.

Cellular-Based Biochemical Assays:

Upon screening our 29 hybridoma antibodies in the cellular biochemical assays, we found that there were 20 clear blockers and 9 non-blockers of the PVRIG-PVRL2 interaction. All of the blocking antibodies were able to inhibit the interaction of PVRIG Fc with HEK cells by at least 50%, with most of these antibodies completely abolishing PVRIG Fc binding. The $IC_{50}$ values associated with those antibodies that did show blocking capacity are reported in FIG. 92. The majority of $IC_{50}$ values were between 20-60 nM.

Summary and Conclusions

Using a hybridoma platform, we have been able to successfully generate monoclonal antibodies towards the human PVRIG antigen. Using engineered over-expressing cells as well as a suite of cancer cell lines, we showed that our antibodies are highly specific to the PVRIG antigen, and are able to detect protein expression which correlated with RNA expression. Upon analysis of human PBMC subsets, we showed that the PVRIG protein is most highly expressed on NK and T cells, with low/negative expression on B cells and myeloid cells. We also showed that a proportion of these antibodies are cross-reactive with the cynomolgus monkey (cyno) PVRIG antigen through assessing their binding to over-expressing cells. Furthermore, the expression pattern on cyno PBMC is similar to human PBMC. Lastly, we were able to show through a FACS-based competition assay, that a proportion of our hybridoma antibodies are able to inhibit the interaction of PVRIG with its ligand, PVRL2. The antibodies which showed the best characteristics regarding all the aforementioned data were CHA-7-518, CHA-7-524, CHA-7-530, and CHA-7-538.

Example 23. Effect of CHA Anti-PVRIG Antibodies in the MLR Assay

An assay used to profile the functional effect of anti-human PVRIG antibodies on allo-antigen responses is proliferation of Human CD8+ T Cells in a Mixed Lymphocyte Reaction (MLR) assay. As is known in the art, MLR is an ex vivo cellular immune assay that provides an in vitro correlation of T cell function.

Anti-PVRIG antibodies are expected to enhance proliferation of human CD4 and CD8 T cells in response to cells from an MHC-mismatched donor. Human T cells are enriched from whole blood of one donor (e.g. donor A) by using Human T cell RosetteSep® (StemCell Technologies) as per manufacturer's instructions. After separation, cells are fluorescently labeled with CFSE dye (Molecular Probes). To serve as allogeneic antigen presenting cells (APCs), mononuclear cells are first isolated from whole blood from a MHC-mismatched donor (e.g. donor B) and then depleted of CD3+ T cells. APCs are then irradiated with 2500 rads in a cesium irradiator.

In general, an MLR assay is done as follows. Human T cells and allogeneic 150,000 APCs are co-cultured in a 96-well flat-bottom plate with 150,000 CD8+ T cells and APCs for 5 days with anti-PVRIG antibodies at different concentrations. On day 5, cells are harvested, washed and stained with anti-CD8-biotin followed by streptavidin-PerCp. Samples are run by FACS to assess the degree of proliferation as depicted by CFSE dilution. Functional blocking anti-PVRIG antibodies are expected to enhance T cells proliferation and cytokine secretion in response to cells from a MHC-mismatched donor.

An MLR assay was used to characterize the biochemical effect of the CHA antibodies of the invention on resting and activated human T cells, and to characterize the capacity of hybridoma-derived antibodies to modulate T cell proliferation in an MLR setting Protocols Mixed Lymphocyte Reaction (MLR):

A mixed lymphocyte reaction was established by co-culturing dendritic cells (DCs) and T cells derived from distinct donors in an allogeneic setting. DCs were generated by culturing purified monocytes with 100 ng/ml GM-CSF (R&D systems) and 100 ng/ml IL-4 (R&D systems) for 7 days. After 7 days, purified CFSE-labelled CD3 T cells were combined with DCs at a 10:1 ratio and were cultured in X vivo-20 serum free media (Lonza) for 5 days. In some conditions, unconjugated anti-PVRIG antibodies or isotype control antibodies were added to the plates at 10 µg/ml. Three MLR assay permutations were set up, where DCs from one donor were co-cultured with CD3 T cells from 3 separate allogeneic donors. All blood products were sourced from Stanford Blood Bank.

Expression and Functional Analysis:

After the 5 day MLR culture, the level and extent of T cell activation and proliferation was assessed by CFSE dilution and expression of activation markers such as CD25 and PD-1. In-house anti-PVRIG antibodies from both phage and hybridoma campaigns were used to assess the expression of PVRIG. Expression of the PVRIG ligand, PVRL2, was also assessed in a kinetic fashion on DC. All data was acquired using flow cytometry and data analysis was performed using FlowJo (Treestar) and Prism (Graphpad) software.

FACS-Based Epitope Analysis:

As we tested an array of antibodies in the MLR, we were interested in determining whether these antibodies could be epitope 'binned' based on FACS-based binding, and whether this 'binning' would correlate to changes in T cell activation and proliferation in the assay. To do this, T cells harvested from the assay were pre-incubated with unconjugated PVRIG antibodies, and then counter-stained with a conjugated PVRIG antibody of a different clone. The extent to which the conjugated PVRIG antibody gave a signal on T cells indicated the extent to which this antibody had to compete for PVRIG binding on T cells with the unconjugated antibody. A negative or low signal would indicate that there is high competition, indicating the two antibodies are in the same epitope 'bin'. A high signal would indicate low or no competition and thus the antibodies would be considered to be in different 'bins'.

Results

Expression of PVRL2 on monocyte-derived DC: To determine whether PVRL2 would be expressed on DC for the MLR assay, DC were generated from monocytes, and PVRL2 expression was assessed in a kinetic fashion at daily intervals after addition of GM-CSF and IL-4. As indicated in FIG. 72, PVRL2 expression increased from Day 0 until Day 5 where expression peaked. At Day 6, expression decreased slightly compared to Day 5. At Day 7, expression was similar to Day 6 indicating stabilization of PVRL2 expression at these time points. Thus, DC expressed PVRL2 at the appropriate time point for use in the MLR assay.

Figure 73A:
FIGS. 73A-73B Expression of PVRIG on CD4 and CD8 T cells in the MLR. The expression of PVRIG on proliferating (CFSE low) and non-proliferating T cells (CFSE high) is shown. Data is derived from three individual CD3 T cell donors and from a range of PVRIG antibodies. CFSE is measured on the X axis and PVRIG expression is measured on the Y axis. The top 3 series of scatter plots indicates PVRIG expression on CD4 T cells, and the bottom 3 series indicates expression on CD8 T cells.
Figure 73B:
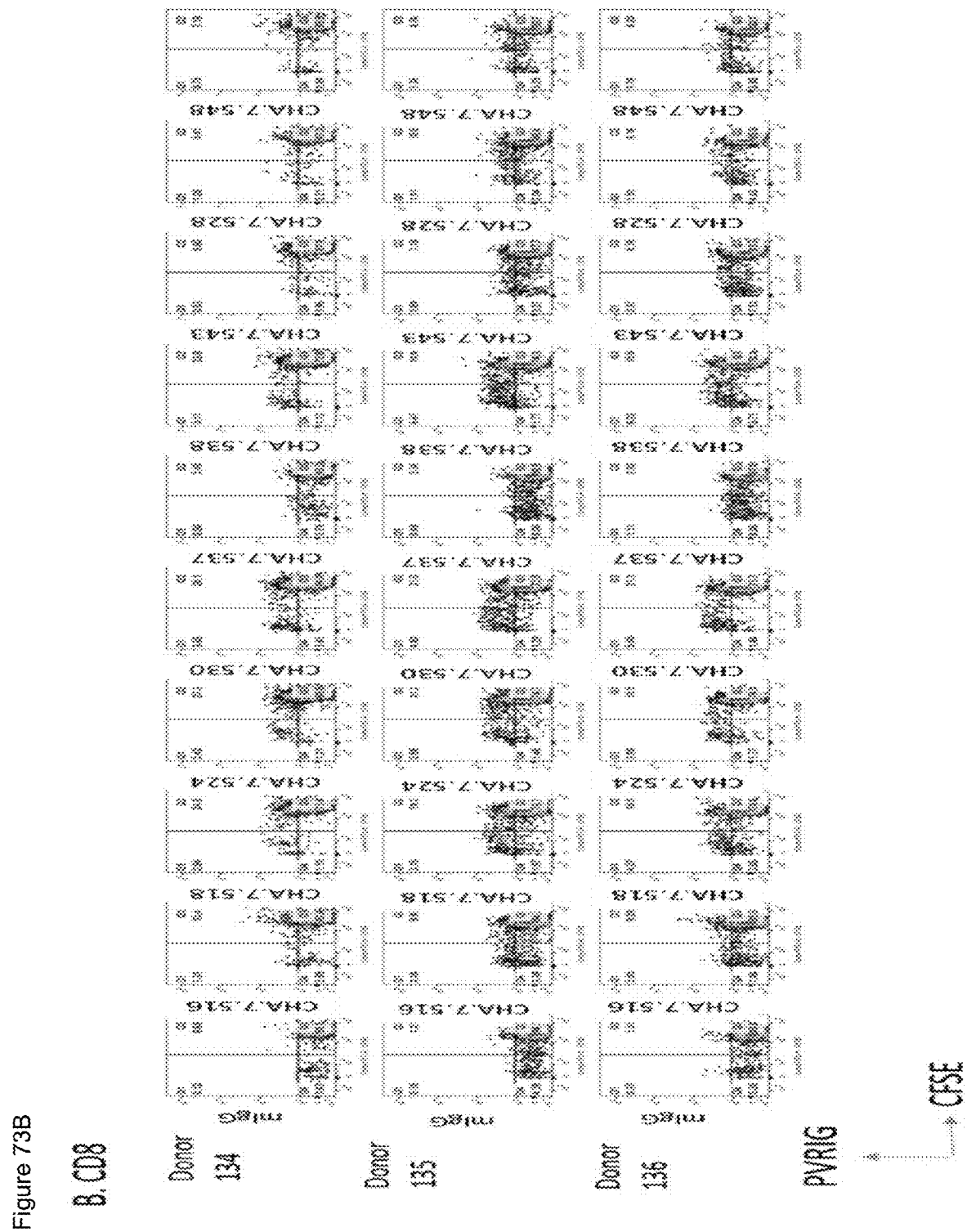
Figures 74A, 74B:
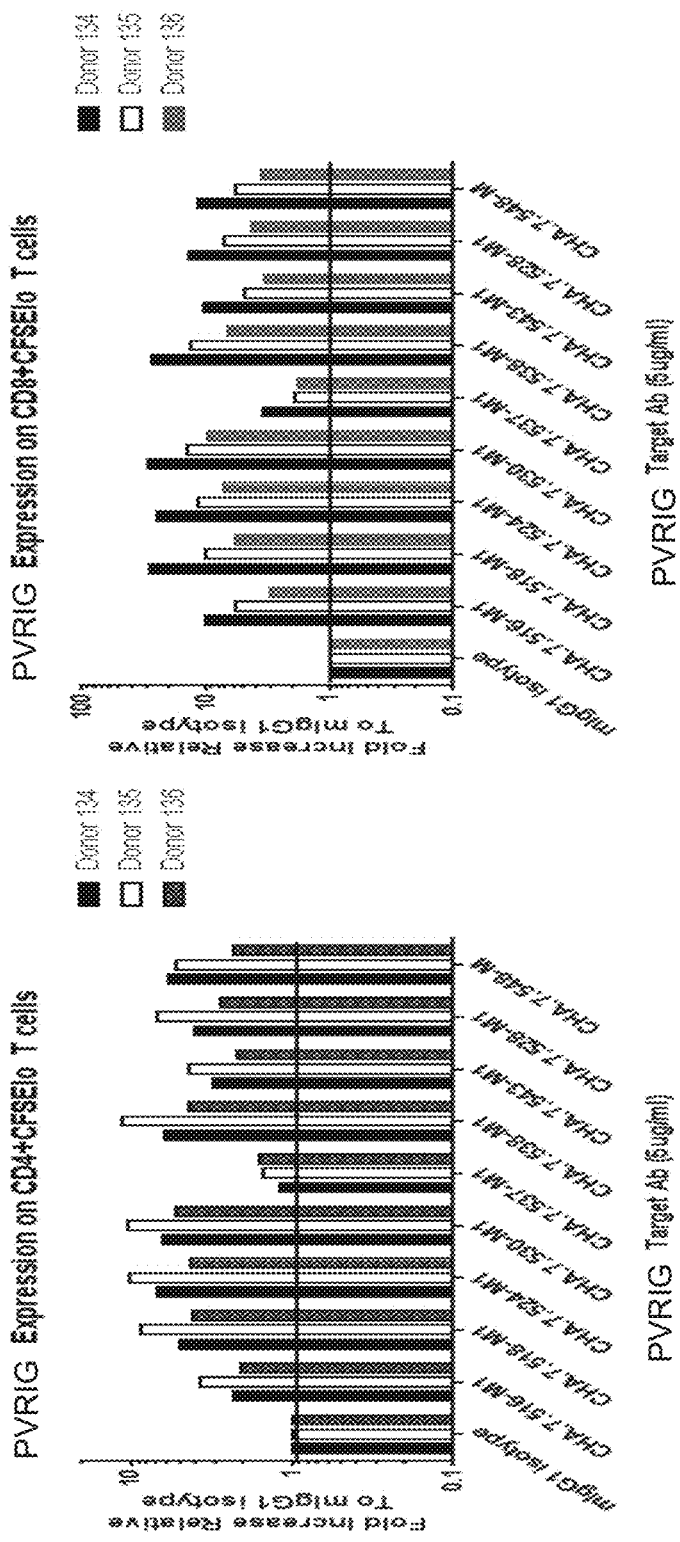
FIGS. 74A-74B Normalised expression of PVRIG on CD4 and CD8 T cells in the MLR. The expression of PVRIG relative to mIgG1 isotype control is shown from three individual CD3 T cell donors across all antibodies analysed.
Figure 75A:
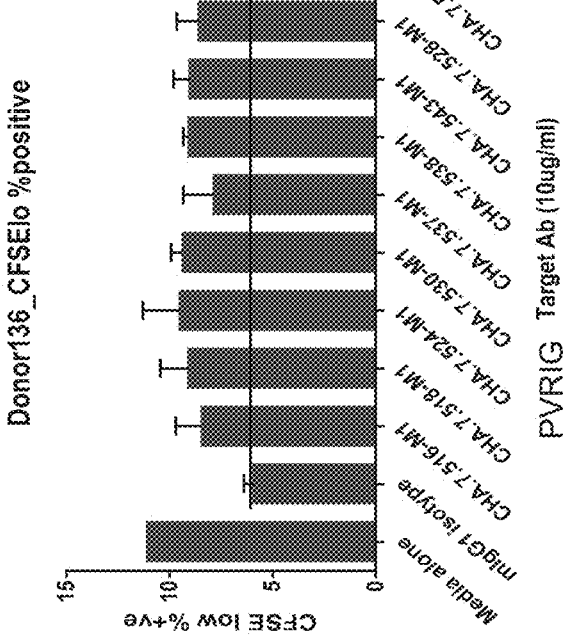
FIGS. 75A-75B PVRIG antibodies increase T cell proliferation in the MLR. The percentages of CFSE low cells are shown from MLR assays treated with the indicated PVRIG antibodies. Each graph represents one individual CD3 T cell donor.
Figure 75B:
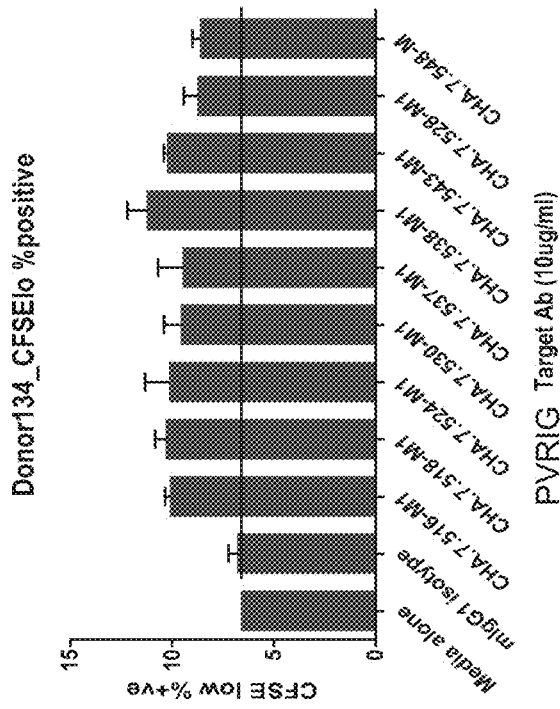

Expression of PVRIG on T Cells after MLR Culture:

Many T cell receptors than modulate function in the MLR are expressed on proliferating T cells. Thus, we wanted to determine whether PVRIG is also expressed. We analysed proliferating T cells at Day 5 post MLR co-culture initiation and were characterized by their dilution of CFSE (i.e. CFSE low). As shown in FIGS. 73A-73B and FIGS. 74A-74B, relative to isotype control (mIgG1), PVRIG was expressed on CFSE low cells as determined by multiple PVRIG antibodies on both CD4 and CD8 T cells across three donors analysed. FACS plots are shown in FIGS. 73A-73B to indicate PVRIG on CFSE low cells, and bar graphs in FIGS. 74A-74B indicate the level of expression of PVRIG relative to mIgG1.

PVRIG Antibodies Enhance T Cell Proliferation:

Having shown that PVRIG expression is expressed on proliferating T cells in the MLR, we wanted to determine whether treatment with PVRIG antibodies could affect levels of T cell proliferation. As shown in FIG. 4, addition of PVRIG antibodies into the MLR assay was able to increase the percentage of CFSE low cells across all the hybridoma antibodies tested compared to control. This was observed across all donors analysed.

Figure 76:
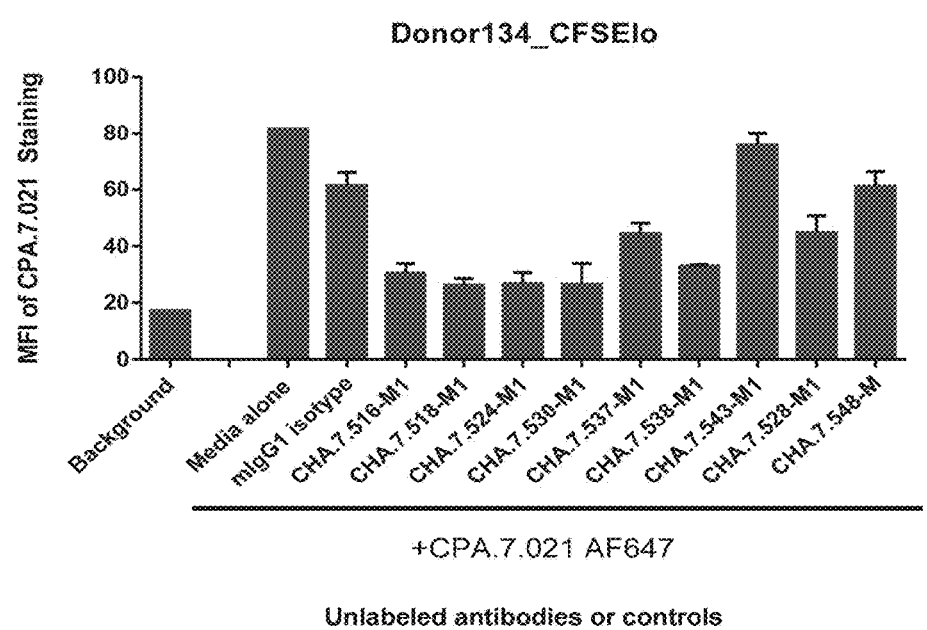
FIG. 76 FACS-based epitope analysis of PVRIG antibodies on T cells. The level of binding of conjugated CPA.7.021 (derived from phage campaign) is indicated after pre-incubation of T cells with unconjugated PVRIG antibodies derived from our hybridoma campaign, as well as relevant controls. Analysis was performed on CFSE low T cells derived from the MLR.

PVRIG Antibodies Bind to Multiple Epitopes on PVRIG:

To compare the PVRIG antibodies for their ability to bind different epitopes on PVRIG, we performed a competition experiment where T cells from the MLR were cultured with unlabeled anti-PVRIG antibodies derived from our hybridoma campaigns for 5 days. T cells were then harvested at day 5 and counter-stained with a conjugated anti-PVRIG antibody that was derived from our phage campaign (CPA.7.021). As shown in FIG. 76, complete or near complete reduction of CPA.7.021 binding was observed in conditions that contained CHA.7.516-M1, CHA.7.518-M1, CHA.7.524-M1, CHA.7.530-M1, and CHA.7.538-M1 when compared to background fluorescence levels, suggesting that these antibodies may overlap in epitope recognition. Partial reduction in CPA.7.021 binding was observed with CHA.7.537-M1, CHA.7.528-M1, and CHA.7.548-M1, suggesting partial overlap in epitope recognition. No reduction in CPA.7.021 binding was observed in cells pre-cultured with CHA.7.543-M1 suggesting an absence of epitope recognition. Collectively, this data indicates that the PVRIG antibodies from our campaigns, when assessed relative to CPA.7.021, could recognize at least 3 different epitopes on PVRIG.

Conclusions

We characterized our PVRIG antibodies for their ability to bind to proliferating and resting T cells, as well as their functional activity in a MLR. Binding of multiple PVRIG antibodies was detected on proliferating T cells and was higher on proliferating T cells as compared to resting, especially the CD8+ subset. This data demonstrates that PVRIG expression is increased upon T cell activation. Furthermore, several PVRIG antibodies increased T cell proliferation as compared to mIgG1 isotype indicating that they can also modulate T cell function. As above, these antibodies all have ability to block PVRIG with its ligand, PVRL2. Based on this, we conclude that by blocking the PVRIG-PVRL2 interaction, these antibodies lead to an increase in T cell activation and proliferation, which is a hallmark indication of a desired effect for an immune checkpoint inhibitor that would be used to treat cancer. Lastly, we performed competition experiments comparing the binding of multiple hybridoma-derived PVRIG antibodies to activated T cells, relative to a phage-derived antibody. From this series of experiments, we provide evidence for epitope diversity of our phage and hybridoma-derived antibodies.

Example 24. Effect of Anti-PVRIG Antibodies on T Cell Activation Upon Combination with Immune Checkpoint Blockade The combination of PVRIG blockade with blocking Abs of a known immune checkpoint (e.g. PD1, PDL-1 or TIGIT), is expected to further enhance the stimulatory effect on T cell activation in the assays depicted above.

Example 25. Functional Analysis of PVRIG Antibodies

The human PVRIG antibodies of the invention were characterized for the ability to inhibit the interaction of PVRIG with its ligand PVRL2, and their ability to modulate effector lymphocyte function in primary cell-based assays.
Protocols
Cellular-Based Biochemical Assays
The ability of PVRIG antibodies to inhibit the interaction of PVRIG with its ligand PVRL2 was assessed in a cellular biochemical assay format in two orientations.

In the first orientation, the ligand PVRL2 is endogenously expressed on un-manipulated HEK cells and soluble biotinylated Fc-tagged PVRIG (manufactured on demand by Genscript) is added. In this case, the ability of PVRIG antibodies to block soluble PVRIG binding to HEK cells were assessed through two permutations. In the first permutation, various concentrations of PVRIG antibodies (range 0.066-66 nM) were pre-incubated with 33 nM of soluble PVRIG in phosphate buffered saline (PBS, Gibco) for 30 minutes on ice. This complex was subsequently added to 100,000 HEK cells in and incubated for a further 1 hour on ice. After 1 hour, HEK cells were washed twice in PBS and the extent of soluble PVRIG bound to HEK cells was detected by addition of streptavidin conjugated to Alexa 647 (Jackson Laboratories) for 30 minutes on ice. HEK cells were washed twice in PBS, and resuspended in 100 ul of PBS for acquisition on the FACS Canto II (BD Biosciences). Data was analysed using FlowJo (Treestar) and Prism (Graphpad) software. In the second permutation, 33 nM of soluble PVRIG protein and PVRIG antibodies (0.066-66 nM) were added concomitantly to 100,000 HEK cells and incubated for 1 hour on ice. Subsequent steps to analysis for this permutation are equivalent to the first permutation.

In the second orientation, HEK cells were engineered to over-express PVRIG and soluble biotinylated Fc-tagged PVRL2 (CD Biosciences) was added. In this case, various concentrations of PVRIG antibodies (range 0-200 nM) with 160 nM soluble PVRL2 were added concomitantly to 100,000 HEK hPVRIG or parental HEK cells, and incubated in PBS+1% BSA+0.1% sodium azide (FACS buffer) for 1 hr on ice. Soluble PVRL2 binding was detected by addition of streptavidin Alexa 647 in FACS buffer for 30 minutes on ice. Cells were washed twice in FACS buffer, and re-suspended in 50 ul of PBS for acquisition on the Intellicyt HTFC (Intellicyt). Data was analyzed using FlowJo (Treestar), Excel (Microsoft) and Prism (GraphPad).

Primary NK Cell Assay

The PBMC subset with the most robust expression profile for PVRIG was on NK cells. As such, we designed an NK cell-based co-culture assay with PVRL2-expressing tumor cells to determine whether our antibodies could modulate NK cell-mediated cytotoxicity towards these targets. The targets we chose were the acute B cell lymphocytic leukemia cell line, Reh (ATCC cell bank), and the acute myeloid leukemia cell line, MOLM-13 (DSMZ cell bank). Reh and MOLM-13 cells were grown in RPMI media (Gibco)+20% fetal calf serum (Gibco), glutamax (Gibco), penicillin/streptomycin (Gibco), non-essential amino acids (Gibco), sodium pyruvate (Gibco), HEPES (Gibco), and beta-mercaptoethanol (Gibco).

Two days prior to the co-culture assay, primary NK cells were isolated using the human NK cell isolation kit (Miltenyi Biotec) and cultured in RPMI media+20% fetal calf serum, glutamax, penicillin/streptomycin, non-essential amino acids, sodium pyruvate, HEPES, beta-mercaptoethanol, and 250 U/ml IL-2 (R&D systems). On the day of the assay NK cells were harvested, enumerated and pre-incubated with PVRIG antibodies for 15-30 minutes at room temperature. During this incubation, target cells were harvested from culture, labelled with Calcein AM (Life Technologies) for 30 minutes at 37° c., washed in media, and enumerated for the assay. NK cell-mediated cytotoxicity assays were set up where a constant number of target cells (50,000) were co-cultured with increasing concentrations of NK cells pre-incubated with 5 µg/ml of PVRIG antibodies (thus altering the NK cell to target ratio). Alternatively, a fixed NK cell to target ratio was used in the assay, but NK cells were pre-incubated with altering concentrations of PVRIG antibody (range 3.9 ng/ml-5 µg/ml) in a dose titration. Upon addition of the NK cells and targets, plates were pulse spun at 1,400 rpm for 1 minute and placed at 37° c. in a 5% $CO_2$ atmosphere for 4 hours. After 4 hours, plates were spun at 1,400 rpm for 4 minutes, and 80 ul of supernatant was harvested to quantitate the release of Calcein AM from the target cells. The quantity of Calcein AM released from targets was assessed by a Spectramax Gemini XS fluorometer (Molecular Devices). As controls for Calcein AM release, total and spontaneous release was assessed by exposing target cells to 70% ethanol or media only for the duration of the assay. Levels of killing (as a percentage) by NK cells were calculated using the following formula:

$$(Sample\ release - spontaneous\ release)/(total\ release - spontaneous\ release)*100$$

In addition to PVRIG antibodies, in some cases, other antibodies towards NK cell receptors such as TIGIT (Genentech, clone 10A7, Patent number: WO2009126688 A2) and DNAM-1 (Biolegend, clone 11A8) were also added as comparators.

Results
Cellular-Based Biochemical Assays:
Upon screening a panel of our PVRIG antibodies in the cellular biochemical assays, we found that there was variable levels of inhibition across the antibodies tested, and the level of inhibition was dependent on the permutation and orientation of the assay (FIG. 98). Four antibodies are specifically shown in FIGS. 93A-93C to illustrate these points. The orientation and permutation of the assay which gave the most robust inhibitory effect relative to control, was when soluble PVRIG pre-incubated with PVRIG antibodies was added to HEK cells (FIG. 93a). In this permutation, CPA.7.021 showed the best absolute blocking capacity compared to the other three antibodies (CPA.7.002, CPA.7.005, and CPA.7.050). Despite the differences in level of blocking, all antibodies in this permutation showed similar $IC_{50}$ values which were in the low nanomolar range, and the blocking capacity plateaued at higher concentrations.

When the absolute level of inhibition invoked by the four PVRIG antibodies was then measured when soluble PVRIG and PVRIG antibodies were concomitantly added to HEK cells, more variability of blocking in the assay was observed (FIG. 93b). CPA.7.021 remained the best blocking antibody. However, CPA.7.002 and CPA.7.005 showed markedly less ability to inhibit soluble PVRIG binding to HEK cells relative to the control antibody. CPA.7.050 showed an intermediate level of blocking as compared to CPA.7.021, CPA.7.002, and CPA.7.005. This difference in absolute level of inhibition also corresponded to differences in the $IC_{50}$ values of each antibody. CPA.7.021 and CPA.7.050 again showed low nanomolar $IC_{50}$ values, although they were both higher than in the first permutation of the assay. In contrast, the $IC_{50}$ values of CPA.7.002 and CPA.7.005 increased substantially, CPA.7.002 by approximately 20-fold, and CPA.7.005 by approximately 30-fold. This data indicates that how the antibody has to compete for PVRIG binding with its cognate ligand, will indicate the potency with which the antibody can block this interaction.

When the orientation of the biochemical assay was reversed (i.e. PVRL2Fc was assessed to bind to HEK hPVRIG cells), the ability of the four PVRIG antibodies to block PVRL2 Fc interaction was variable (FIG. 93c). Consistent with the biochemical assays which used HEK cells as targets (FIGS. 93a-b), CPA.7.021 and CPA.7.050 inhibited PVRL2 Fc binding to HEK hPVRIG cells, and their ability to block the binding was similar. Surprisingly however, we saw enhancement of PVRL2 Fc binding in the presence of CPA.7.002 and CPA.7.005 antibodies which we did not observe when HEK cells were used as targets.

NK Cell Cytotoxicity Assay with Reh Cells:

The first target we investigated in the NK cell cytotoxicity assay was the Reh line. Reh was initially selected as it showed robust levels of PVRL2 by flow cytometry, but a low frequency of other activating ligands such as NKG2D ligands, and low expression of PVR (FIGS. 94A-94H). Traditional NK cell targets were not used, such as K562, due to their expression of a high frequency of NKG2D ligands, and high expression of PVR, which may mask a functional effect of the PVRIG antibodies. Importantly, Reh cells did not express any NK cell receptors known to interact with PVRL2 and PVR such as TIGIT, DNAM-1, and PVRIG.

Figure 95A:
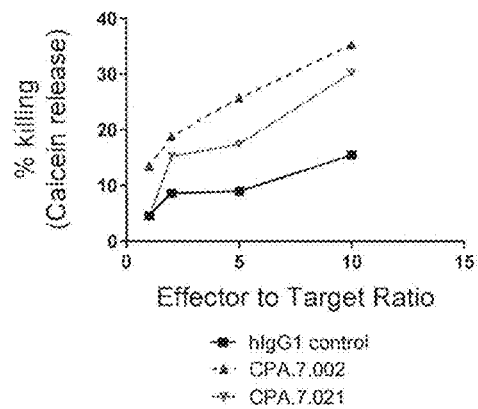
Figure 95B:
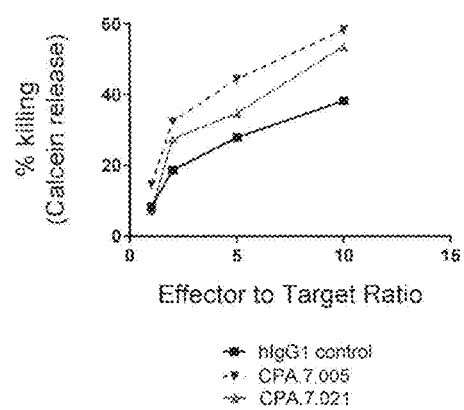
Figure 95C:
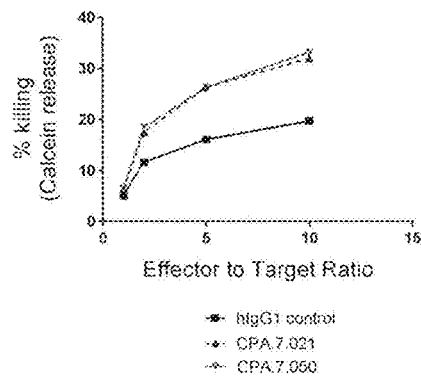
Figure 95D:
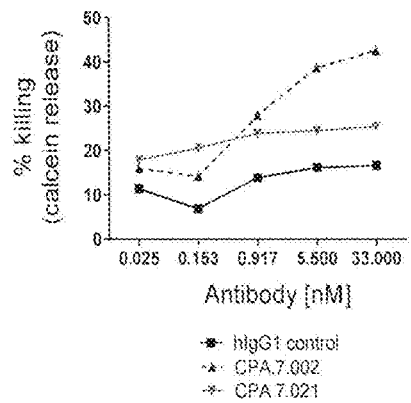
Figure 95E:
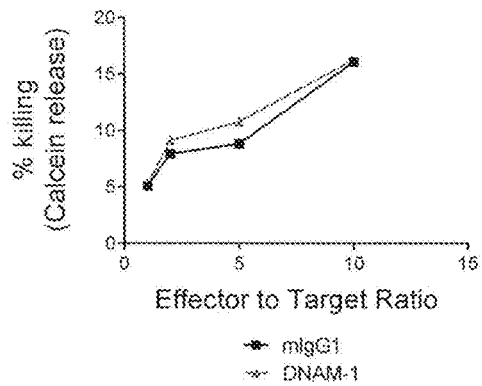
Figure 95F:
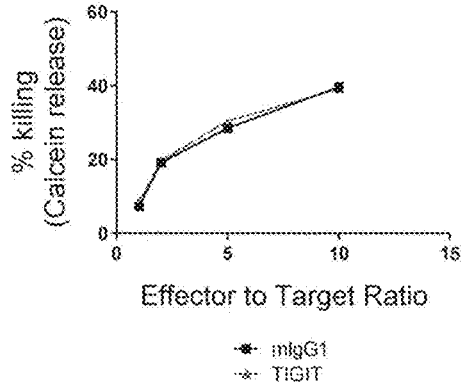

Upon screening our panel of PVRIG antibodies in this assay, we found four antibodies that were able to modulate NK cell-mediated cytotoxicity (FIG. 99). These four antibodies were those that were discussed in the biochemical assay results section-CPA.7.002, CPA.7.005, CPA.7.021, and CPA.7.050. In all cases, addition of these antibodies enhanced NK cell-mediated cytotoxicity against Reh cells (FIGS. 95a-95c). Addition of CPA.7.002 and CPA.7.005 enhanced cytotoxicity most robustly (FIGS. 95a-95b), followed by CPA.7.021 and CPA.7.050 which showed similar levels of enhancement (FIG. 95c). FIG. 95d shows a concentration-dependent analysis of enhancement of NK cell-mediated cytotoxicity by CPA.7.002 and CPA.7.021. Blocking antibodies towards receptors that have been reported to also bind PVRL2 such as TIGIT and DNAM-1 were added to the assay with Reh cells as comparators. As shown in FIGS. 95a-95f, the addition of TIGIT and DNAM-1 antibodies did not show functional effects in this assay.

NK Cell Assay with MOLM-13 Cells:

To assess whether PVRIG antibodies were able to modulate NK cell-mediated cytotoxicity against a second target, MOLM-13 cells were utilized. MOLM-13 also express PVRL2 analogous to Reh cells, but also have robust expression of PVR (FIGS. 94A-94H). Like the Reh cells, MOLM-13 did not express any NK cell receptors. Utilization of this cell line, in addition to Reh cells, would indicate whether PVRIG antibodies can modulate NK cell-mediated cytotoxicity in the context of different receptor-ligand interactions, particularly when PVR is expressed.

Upon screening our PVRIG antibodies in this assay, we found that the functional effect of CPA.7.021 was diminished and did not show significant enhancement of NK cell-mediated cytotoxicity above control levels (FIG. 97a). In contrast, CPA.7.002 and CPA.7.005 were able to enhance NK cell-mediated cytotoxicity in this assay (FIG. 97a). Using a comparator antibody, blockade of TIGIT did not show functional effects in this assay when compared to control (FIG. 97b).

Summary and Conclusions

Using our antibody phage platform, we generated a panel of antibodies against the human PVRIG antigen that showed an ability to block the interaction of PVRIG with its ligand PVRL2, and enhance NK cell-mediated cytotoxicity against two hematological cell lines. The ability of the PVRIG antibodies to inhibit PVRIG and PVRL2 interaction was influenced by the orientation of the assay as well as pre-incubation steps, representative of potential antibody dynamics with PVRIG in physiological settings such as cancer. Four antibodies showed an ability to enhance NK cell-mediated cytotoxicity against the Reh cell line, but only two antibodies showed an ability to enhance cytotoxicity against MOLM-13 cells. This difference may be attributed to the alternate receptor-ligand interactions involved in NK cell-mediated recognition of each cell line, and/or differential properties of the antibodies and their potency in modulating the function of PVRIG.

Example 26. Effect of Anti-PVRIG Antibodies on GD T Cell Activation Using PVRL2 Ectopic or Naturally Expressing Cells A cell based assay is used to test the effect of anti-PVRIG antibodies on gamma delta T cell activation, proliferation and cytokine secretion. Purified human gamma delta T cells are activated with HMBPP or IPP and co-cultured with target cells (e.g. REH, MOLM-13) that naturally express PVRL2 or with target cells ectopically expressing PVRL2 or empty vector (e.g. CHO, Raji, 721.221). Gamma delta T cell function is assessed by examining cytokine production (e.g. IFN-γ, IL-17)_in cultured supernatants or cytotoxic activity on the target cells. PVLR2 expression is expected to have a basal stimulatory effect on gamma delta T cell activation, mediated through endogenous DNAM1—a known costimulatory counterpart receptor of PVRL2 on gamma delta T cells. In the presence of antagonistic anti-PVRIG Abs, cytokine production or cytotoxic activity is expected to be further enhanced, due to their blocking of the inhibitory function of endogenous PVRIG on gamma delta T cell activation. Accordingly, agonistic anti-PVRIG Abs are expected to show inhibition of gamma delta T cell activation.

Example 27: Effect of Proteins on Human T Cells Activated Using Anti-CD3 and Anti-CD28 in the Presence of Autologous PBMCs Materials and Methods In these experiments the effects of PVRIG on human T cells which were activated using anti-CD3 and anti-CD28 in the presence of autologous PBMCS is evaluated. Conversely, this assay can also be used to assay the effects of anti-PVRIG antibodies on T cell activation.

PVRIG hECD-hIg fusion protein (FIG. 92BA), composed of the ECD of human PVRIG fused to the Fc of human IgG1 bearing C220, C226 and C229 to S mutations at the hinge, was produced at GenScript (China) by transient transfection in CHO-3E7 cells which were cultured for 6 days, followed by protein A purification of cell harvest. The final product was formulated in PBS pH 7.2. Expression vector used was Mammalian Expression Vector pTT5, in which PVRIG gene is driven by CMV promoter.

CD4+ Human T cell Isolation Kit II is purchased from Miltenyi (Cat. #130-094-131). hIgG1 control (Synagis®) is obtained from Medimmune Inc. Anti-human CD3 Ab (OKT3, Cat#16-0037) and anti-human CD28 Ab (clone CD28. 2; Cat#16-0289) are purchased from eBioscience. Dynabeads M-450 Epoxy (Cat. #140. 11) are purchased from Invitrogen. Buffy coats of human blood are obtained from LifeSource. Ficoll-Paque Plus (Cat. #17-1440-02), is purchased from GE HealthCare.

Isolation of PBMCs from Buffy Coats Using Ficoll Separation:

Total PBMCs are suspended in Ex-Vivo 20 medium, and irradiated at 3000 rad. Naïve CD4+ T cells are isolated from buffy coats of three healthy human donors' blood using CD4+ Human T cell Isolation Kit II (Miltenyi) according to manufacturer's instructions and co-cultured with irradiated autologous PBMCs at a ratio of 1:1 ($1.5 \times 10^5$ T cells with $1.5 \times 10^5$ irradiated PBMCs per well). The cultures are activated with anti-CD3 (0.5 μg/ml) and anti-CD28 (0.5 μg/ml) antibodies. Either an anti-PVRIG antibody or a PVRIG ECD protein are added to the culture at the indicated concentrations. After 24 hr in culture, cells are pulsed with H3-thymidine. Cells are harvested after 72 hours in culture.

For the ECD experiment, the results are expected to cause a dose dependent inhibition of T cell proliferation and/or activation, supporting the therapeutic potential of immunoinhibitory PVRIG based therapeutic agents (e.g. PVRIG polypeptides or PVRIG fusion proteins according to at least some embodiments of the invention) for treating T cell-driven autoimmune diseases, such as rheumatoid arthritis, multiple sclerosis, psoriasis and inflammatory bowel disease, as well as for treating other immune related diseases and/or for reducing the undesirable immune activation that follows gene or cell therapy. Essentially, immunoinhibitory PVRIG proteins that agonize PVRIG should prevent or reduce the activation of T cells and the production of proinflammatory cytokines involved in the disease pathology of such conditions.

In addition, these results are also expected to support a therapeutic potential of immunostimulatory anti-PVRIG antibodies that reduce the inhibitory activity of PVRIG for treating conditions which will benefit from enhanced immune responses such as immunotherapy of cancer, infectious diseases, particularly chronic infections and sepsis. Essentially, immunostimulatory anti=PVRIG antibodies will promote the activation of T cells and elicit the production of proinflammatory cytokines thereby promoting the depletion of cancerous or infected cells or infectious agents.

Example 28: Inhibition of T Cell Activation Assay

In these experiments the effects of PVRIG ECDs or anti-PVRIG antibodies on T cell activation in a bead assay.

Materials & Methods

Isolation of Human T Cells:

Buffy coats are obtained from Stanford Blood Bank from healthy human donors. CD3+ T cells are isolated from buffy coats using RosetteSep kit (StemCell Technologies) following manufacturer's instructions. Cells are analyzed with anti-CD45 and anti-CD3 by flow cytometry to evaluate the % of CD3+ cells obtained. Viability is evaluated after thawing prior to the assay.

Bead Coating and QC:

Tosyl activated beads (Invitrogen, Cat#14013) at $500 \times 10^6$/ml are coated with anti-CD3 mAb and either PVRIG ECD proteins or anti-PVRIG antibodies in a two-step protocol: with 50 μg/ml human anti-CD3 clone UTCH1 (R&D systems, Cat#mab 100) in sodium phosphate buffer at 37° C. overnight, followed with 0-320 μg/ml of either PVRIG ECD proteins or anti-PVRIG antibodies for another overnight incubation at 37° C.

The amount of PVRIG protein (either ECD or antibody) bound to the beads is analyzed.

Bead assay setup: 100k human CD3+ T cells are cultured with 100k or 200k beads coated with various concentrations of the PVRIG protein for 5 days in complete IMDM (Gibco, Cat #12440-053) supplemented with 2% AB human serum (Gibco, Cat#34005-100), Glutmax (Gibco, Cat #35050-061), sodium pyruvate (Gibco, Cat #11360-070), MEM Non-Essential Amino Acids Solution (Gibco, Cat #11140-050), and 2-mercaptoethanol (Gibco, Cat #21985). At the end of 5 day culture, cells are stained with anti-CD25, anti-CD4, anti-CD8, and fixable live dead dye to determine CD25 expression levels on each subset of cells. Supernatants are collected and assayed for IFNγ secretion by ELISA (Human INFγ duoset, R&D systems, DY285).

In these experiments human CD3 T cells co-cultured with beads coated with various concentration of PVRIG-protein are analyzed for their level of expression of CD25. Both CD4+ and CD8+ cells are anticipated to show dose dependent inhibition by the PVRIG-ECD-fusion protein, or, conversely, both CD4+ and CD8+ cells are anticipated to show dose dependent activation by the PVRIG-antibody.

Example 29: Epitope Mapping of Anti-Human PVRIG Antibodies Based On Cynomolgus Cross-Reactivity Rationale and Objectives The objective of this study is to identify the epitopes on the PVRIG protein that determine cross-reactivity of anti-human PVRIG antibodies against the cynomolgus monkey (cyno) orthologue. Many of the lead antibodies against human PVRIG target show varied degrees of cyno cross-reactivity despite the fact that many of these antibodies belong to the same epitope bin. To shed light on the molecular basis of human/cyno cross-reactivity (or lack thereof), several cyno-to-human mutations of the PVRIG recombinant proteins were designed, expressed and purified, and tested for binding to a panel of anti-human PVRIG antibodies in ELISA.

Methods

Design of cyno-to-human PVRIG variants: Sequence alignment of human and PVRIG extracellular domains (ECDs) shows 90% sequence identity and 93% sequence homology between human and cyno orthologs (FIG. 100).

Based on the nature of the mutations (conserved vs non-conserved) and the secondary structure prediction (coil vs extended) of the mutation region, three site-directed mutants of the cyno PVRIG were designed to probe the cyno-cross reactivity focused epitope mapping. These mutants include H61R, P67S, and L95R/T97I cyno PVRIG. Wild type cyno and human PVRIG were also generated.

Expression and purification of cyno, human, and hybrid PVRIG variants: All the PVRIG variants were expressed as ECD fusions with a C-terminal 6× His tag (SEQ ID NO: 7) in mammalian cells. The proteins were purified by affinity purification, ion-exchange chromatography, and size-exclusion chromatography. The purified proteins were buffer-exchanged into PBS buffer (pH 7.4) and stored at 4° C.

ELISA to determine PVRIG-antibody interaction: The functional ELISA was performed as follows: cyno, human, and cyno/human hybrid PVRIG (His-tagged) recombinant proteins were adsorbed on an IA plate overnight at 4° C. Coated plate wells were rinsed twice with PBS and incubated with 300 µL blocking buffer (5% skim milk powder in PBS pH 7.4) at room temperature (RT) for 1 hr. Blocking buffer was removed and plates were rinsed twice more with PBS. Plate-bound PVRIG variants were incubated with anti-human PVRIG mAbs (human IgG1 isotype) in solution (linear range of 0.1 µg/mL to 8 µg/mL in a 50 µL/well volume) at RT for 1 hr. Plates were washed three times with PBS-T (PBS 7.4, 0.05% Tween20), then three times with PBS and 50 µL/well of a HRP-conjugated secondary antibody was added (Human IgG Fc domain specific, Jackson ImmunoResearch). This was incubated at RT for 1 hr and plates were washed again. ELISA signals were developed in all wells by adding 50 µL of Sureblue TMB substrate (KPL Inc) and incubating for 5-20 mins. The HRP reaction was stopped by adding 50 µL 2N H2SO4 (VWR) and absorbance signals at 450 nm were read on a SpectraMax (Molecular Devices) or EnVision (PerkinElmer) spectrophotometer. The data were exported to Excel (Microsoft) and plotted in GraphPad Prism (GraphPad Software, Inc.).

Results

S67, R95, and I97 residues as determinants of cyno cross-reactivity: The binding data shown in FIG. 101 clearly shows that the S67, R95, and I97 residues affect the cyno cross-reactivity of various antibodies. While the P67S cyno-to-human mutation negatively impacts the binding of CPA.7.002 and CPA.7.041, the L95R/T97I cyno-to-human mutation significantly improves the binding of CPA.7.002, CPA.7.021, CPA.7.028, and CPA.7.041. On the other hand, H61R cyno-to-human mutation does not affect the binding of any of the antibodies tested.

Relative binding to cyno-to-human variants suggests three epitope groups: The relative binding of the antibodies to cyno, human and hybrid PVRIG variants suggests 3 distinct epitope groups: Group 1 binds to R95/I97 residues (CPA.7.021 and CPA.7.028). Group 2 binds to S67 and R95/I97 residues (CPA.7.002 and CPA.7.041). Group 3 does not bind to S67 or R95/I97 residues (CPA.7.024 and CPA.7.050). The epitope groups show strong correlation to the degree of cyno cross-reactivity of these antibodies (FIG. 102).

Summary and Conclusions

The restricted epitope mapping based on cyno-to-human variations in the PVRIG ECD identified S67, R95, and I97 residues as determinants of cyno cross-reactivity of anti-human PVRIG antibodies. The complete restoration of binding to L95R/T97I cyno PVRIG for CPA.7.021 and CPA.7.028 antibodies and improved binding of CPA.7.002 to this mutant strongly suggests that R95 and I97 residues are critical human PVRIG epitopes for these antibodies. These findings also suggest a possible way to predict cross-reactivity to non-human primate PVRIG orthologs based on their primary amino acid sequence.

SEQUENCE LISTING (1542 sequences)

SEQ ID NO: 1 - protein, 15 aa, Artificial Sequence
  Description of Artificial Sequence: Synthetic peptide
GGGGSGGGGSGGGGS

SEQ ID NO: 2 - DNA, 20 bp, Artificial Sequence
  Description of Artificial Sequence: Synthetic primer
cttgtgttcaccacctctgg

SEQ ID NO: 3 - DNA, 20 bp, Artificial Sequence
  Description of Artificial Sequence: Synthetic primer
tgttctcatcgcaggaggtc

SEQ ID NO: 4 - DNA, 20 bp, Artificial Sequence
  Description of Artificial Sequence: Synthetic primer
ttggctgtggatacctcctt

SEQ ID NO: 5 - DNA, 20 bp, Artificial Sequence
  Description of Artificial Sequence: Synthetic primer
ataagggtcgtggagagcag

SEQ ID NO: 6 - protein, 8 aa, Artificial Sequence
  Description of Artificial Sequence: Synthetic peptide
DYKDDDDK

SEQ ID NO: 7 - protein, 6 aa, Artificial Sequence
  Description of Artificial Sequence: Synthetic 6xHis tag
HHHHHH

SEQ ID NO: 8 - protein, 204 aa, Homo sapiens
MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQA

SEQ ID NO: 9 - protein, 224 aa, Homo sapiens
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQA

SEQ ID NO: 10 - protein, 19 aa, Artificial Sequence
  Description of Artificial Sequence: Synthetic peptide
MGWSCIILFLVATATGVHS

SEQ ID NO: 11 - protein, 382 aa, Artificial Sequence
  Description of Artificial Sequence: Synthetic polypeptide
MGWSCIILFLVATATGVHSTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 479 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 13 - protein, 518 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSY

SEQ ID NO: 14 - protein, 8 aa, Artificial Sequence
  Description of Artificial Sequence: Synthetic peptide
GGTFSSYA

SEQ ID NO: 15 - protein, 8 aa, Artificial Sequence
  Description of Artificial Sequence: Synthetic peptide
IIPIFGTA

SEQ ID NO: 16 - protein, 13 aa, Artificial Sequence
  Description of Artificial Sequence: Synthetic peptide
AREEVSSPYGMDV

SEQ ID NO: 17 - protein, 9 aa, Artificial Sequence
  Description of Artificial Sequence: Synthetic peptide
TGAVTSGHY

SEQ ID NO: 18 - protein, 3 aa, Artificial Sequence
  Description of Artificial Sequence: Synthetic peptide
DTG

SEQ ID NO: 19 - protein, 10 aa, Artificial Sequence
  Description of Artificial Sequence: Synthetic peptide
LLSYSGASWV

SEQ ID NO: 20 - protein, 8 aa, Artificial Sequence
  Description of Artificial Sequence: Synthetic peptide
GFSLSHFS

SEQ ID NO: 21 - protein, 8 aa, Artificial Sequence
  Description of Artificial Sequence: Synthetic peptide
FDPEEGGT

SEQ ID NO: 22 - protein, 14 aa, Artificial Sequence
  Description of Artificial Sequence: Synthetic peptide
ATGIWYSSGWPVDY

SEQ ID NO: 23 - protein, 11 aa, Artificial Sequence
  Description of Artificial Sequence: Synthetic peptide
QSLLDSSGYNY

SEQ ID NO: 24 - protein, 3 aa, Artificial Sequence
  Description of Artificial Sequence: Synthetic peptide
LGS

SEQ ID NO: 25 - protein, 9 aa, Artificial Sequence
  Description of Artificial Sequence: Synthetic peptide
MQALQTPIT

SEQ ID NO: 26 - protein, 8 aa, Artificial Sequence
  Description of Artificial Sequence: Synthetic peptide
GYTLTELS

SEQ ID NO: 27 - protein, 8 aa, Artificial Sequence
  Description of Artificial Sequence: Synthetic peptide
FDPEDGET

SEQ ID NO: 28 - protein, 18 aa, Artificial Sequence
  Description of Artificial Sequence: Synthetic peptide
ATVSRVRGVINYYYYMDV

SEQ ID NO: 29 - protein, 11 aa, Artificial Sequence
  Description of Artificial Sequence: Synthetic peptide
QSLLYRNGNNY

SEQ ID NO: 30 - protein, 3 aa, Artificial Sequence
  Description of Artificial Sequence: Synthetic peptide
LGS

SEQ ID NO: 31 - protein, 9 aa, Artificial Sequence
  Description of Artificial Sequence: Synthetic peptide
MQALQTPPT

SEQ ID NO: 32 - protein, 8 aa, Artificial Sequence
  Description of Artificial Sequence: Synthetic peptide
GGTFGTYA

SEQ ID NO: 33 - protein, 8 aa, Artificial Sequence
  Description of Artificial Sequence: Synthetic peptide
ITPISATI

SEQ ID NO: 34 - protein, 13 aa, Artificial Sequence
  Description of Artificial Sequence: Synthetic peptide
ARGFEYSDGLLDD

SEQ ID NO: 35 - protein, 12 aa, Artificial Sequence
  Description of Artificial Sequence: Synthetic peptide
QSLFYSDDGNTY

SEQ ID NO: 36 - protein, 3 aa, Artificial Sequence
  Description of Artificial Sequence: Synthetic peptide
RLS

SEQ ID NO: 37 - protein, 9 aa, Artificial Sequence
  Description of Artificial Sequence: Synthetic peptide
MQHMEFPLT

SEQ ID NO: 38 - protein, 9 aa, Artificial Sequence
  Description of Artificial Sequence: Synthetic peptide
SGSISSTNW

SEQ ID NO: 39 - protein, 7 aa, Artificial Sequence
  Description of Artificial Sequence: Synthetic peptide
IYHSGST

SEQ ID NO: 40 - protein, 10 aa, Artificial Sequence
  Description of Artificial Sequence: Synthetic peptide
ARVGPAAIYY

SEQ ID NO: 41 - protein, 8 aa, Artificial Sequence
  Description of Artificial Sequence: Synthetic peptide
SNNVGYEG

SEQ ID NO: 42 - protein, 3 aa, Artificial Sequence
  Description of Artificial Sequence: Synthetic peptide
RNN

SEQ ID NO: 43 - protein, 11 aa, Artificial Sequence
  Description of Artificial Sequence: Synthetic peptide
SAWDSSLNAVV

SEQ ID NO: 44 - protein, 8 aa, Artificial Sequence
  Description of Artificial Sequence: Synthetic peptide
GYTLTELS

SEQ ID NO: 45 - protein, 8 aa, Artificial Sequence
  Description of Artificial Sequence: Synthetic peptide
FDPEDGET

SEQ ID NO: 46 - protein, 21 aa, Artificial Sequence
  Description of Artificial Sequence: Synthetic peptide
ATAKPGIAVAGQNYYYYYMDV

SEQ ID NO: 47 - protein, 11 aa, Artificial Sequence
  Description of Artificial Sequence: Synthetic peptide
QSLLYRNGNNY

SEQ ID NO: 48 - protein, 3 aa, Artificial Sequence
  Description of Artificial Sequence: Synthetic peptide
LGS

SEQ ID NO: 49 - protein, 9 aa, Artificial Sequence
  Description of Artificial Sequence: Synthetic peptide
MQALQTPPT

SEQ ID NO: 50 - protein, 8 aa, Artificial Sequence
  Description of Artificial Sequence: Synthetic peptide
GFTFSSYA

SEQ ID NO: 51 - protein, 8 aa, Artificial Sequence
  Description of Artificial Sequence: Synthetic peptide
ISYDGSNK

SEQ ID NO: 52 - protein, 17 aa, Artificial Sequence
  Description of Artificial Sequence: Synthetic peptide
ASSPIGYSYGYWGGMDV

SEQ ID NO: 53 - protein, 9 aa, Artificial Sequence
  Description of Artificial Sequence: Synthetic peptide
SGIDVRTNK

SEQ ID NO: 54 - protein, 7 aa, Artificial Sequence
  Description of Artificial Sequence: Synthetic peptide
FQSDSDK

SEQ ID NO: 55 - protein, 9 aa, Artificial Sequence
  Description of Artificial Sequence: Synthetic peptide
LIWHTSGWV

SEQ ID NO: 56 - protein, 8 aa, Artificial Sequence
  Description of Artificial Sequence: Synthetic peptide
GYTLTELS

SEQ ID NO: 57 - protein, 8 aa, Artificial Sequence
  Description of Artificial Sequence: Synthetic peptide
FDPEDGET

SEQ ID NO: 58 - protein, 17 aa, Artificial Sequence
  Description of Artificial Sequence: Synthetic peptide
ATGPAAAGVGYYYYMDV

SEQ ID NO: 59 - protein, 11 aa, Artificial Sequence
  Description of Artificial Sequence: Synthetic peptide
QSLLYRNGYNY

SEQ ID NO: 60 - protein, 3 aa, Artificial Sequence
  Description of Artificial Sequence: Synthetic peptide
LGS

SEQ ID NO: 61 - protein, 9 aa, Artificial Sequence
  Description of Artificial Sequence: Synthetic peptide
MQALQTPPT

SEQ ID NO: 62 - protein, 8 aa, Artificial Sequence
  Description of Artificial Sequence: Synthetic peptide
GFTFSSYA

SEQ ID NO: 63 - protein, 8 aa, Artificial Sequence
  Description of Artificial Sequence: Synthetic peptide
ISYDGSNK

SEQ ID NO: 64 - protein, 20 aa, Artificial Sequence
  Description of Artificial Sequence: Synthetic peptide
ARDVMVYCSSTSCYFYGMDV

SEQ ID NO: 65 - protein, 6 aa, Artificial Sequence
  Description of Artificial Sequence: Synthetic peptide
QDIRDY

SEQ ID NO: 66 - protein, 3 aa, Artificial Sequence
  Description of Artificial Sequence: Synthetic peptide
DAS

SEQ ID NO: 67 - protein, 9 aa, Artificial Sequence
  Description of Artificial Sequence: Synthetic peptide
QQFENLPIT

SEQ ID NO: 68 - protein, 8 aa, Artificial Sequence
  Description of Artificial Sequence: Synthetic peptide
GYTLTELS

SEQ ID NO: 69 - protein, 8 aa, Artificial Sequence
  Description of Artificial Sequence: Synthetic peptide
FDPEDGET

SEQ ID NO: 70 - protein, 18 aa, Artificial Sequence
  Description of Artificial Sequence: Synthetic peptide
ATGGYSSGFNYYYYYMDV

SEQ ID NO: 71 - protein, 11 aa, Artificial Sequence
  Description of Artificial Sequence: Synthetic peptide
QSLLYRNGNNY

SEQ ID NO: 72 - protein, 3 aa, Artificial Sequence
  Description of Artificial Sequence: Synthetic peptide
LGS

SEQ ID NO: 73 - protein, 9 aa, Artificial Sequence
  Description of Artificial Sequence: Synthetic peptide
MQALQTPPT

SEQ ID NO: 74 - protein, 8 aa, Artificial Sequence
  Description of Artificial Sequence: Synthetic peptide
GYTLTELS

SEQ ID NO: 75 - protein, 8 aa, Artificial Sequence
  Description of Artificial Sequence: Synthetic peptide
FDPEDGET

SEQ ID NO: 76 - protein, 14 aa, Artificial Sequence
  Description of Artificial Sequence: Synthetic peptide
ATGVTTYYYYGMDV

SEQ ID NO: 77 - protein, 11 aa, Artificial Sequence
  Description of Artificial Sequence: Synthetic peptide
QSLLYSNGNNF

SEQ ID NO: 78 - protein, 3 aa, Artificial Sequence
  Description of Artificial Sequence: Synthetic peptide
LGS

SEQ ID NO: 79 - protein, 9 aa, Artificial Sequence
  Description of Artificial Sequence: Synthetic peptide
MQALQTPPT

SEQ ID NO: 80 - protein, 8 aa, Artificial Sequence
  Description of Artificial Sequence: Synthetic peptide
GFTFSSYG

SEQ ID NO: 81 - protein, 8 aa, Artificial Sequence
  Description of Artificial Sequence: Synthetic peptide
IRYDGSNK

SEQ ID NO: 82 - protein, 14 aa, Artificial Sequence
  Description of Artificial Sequence: Synthetic peptide
ARDLFDFWWDGMDV

SEQ ID NO: 83 - protein, 7 aa, Artificial Sequence
  Description of Artificial Sequence: Synthetic peptide
QSVSSMY

SEQ ID NO: 84 - protein, 3 aa, Artificial Sequence
  Description of Artificial Sequence: Synthetic peptide
GAS

SEQ ID NO: 85 - protein, 10 aa, Artificial Sequence
  Description of Artificial Sequence: Synthetic peptide
QQYVSSPMYT

SEQ ID NO: 86 - protein, 8 aa, Artificial Sequence
  Description of Artificial Sequence: Synthetic peptide
GGTFNNYG

SEQ ID NO: 87 - protein, 8 aa, Artificial Sequence
  Description of Artificial Sequence: Synthetic peptide
IIPLFGTT

SEQ ID NO: 88 - protein, 15 aa, Artificial Sequence
  Description of Artificial Sequence: Synthetic peptide
ARDRMAADGMAVFDY

SEQ ID NO: 89 - protein, 8 aa, Artificial Sequence
  Description of Artificial Sequence: Synthetic peptide
SSNIGRHF

SEQ ID NO: 90 - protein, 3 aa, Artificial Sequence
  Description of Artificial Sequence: Synthetic peptide
KND

SEQ ID NO: 91 - protein, 11 aa, Artificial Sequence
  Description of Artificial Sequence: Synthetic peptide
SSWDAALNGVV

SEQ ID NO: 92 - protein, 8 aa, Artificial Sequence
  Description of Artificial Sequence: Synthetic peptide
GYTLTELS

SEQ ID NO: 93 - protein, 8 aa, Artificial Sequence
  Description of Artificial Sequence: Synthetic peptide
FDPEDGET

SEQ ID NO: 94 - protein, 19 aa, Artificial Sequence
  Description of Artificial Sequence: Synthetic peptide
ATEVPMVRGARRYYYYMDV

SEQ ID NO: 95 - protein, 11 aa, Artificial Sequence
  Description of Artificial Sequence: Synthetic peptide
QTLLYINENNY

SEQ ID NO: 96 - protein, 3 aa, Artificial Sequence
  Description of Artificial Sequence: Synthetic peptide
LGS

SEQ ID NO: 97 - protein, 9 aa, Artificial Sequence
  Description of Artificial Sequence: Synthetic peptide
MQGLQTPPT

SEQ ID NO: 98 - protein, 10 aa, Artificial Sequence
  Description of Artificial Sequence: Synthetic peptide
GGSISNSNYY

SEQ ID NO: 99 - protein, 7 aa, Artificial Sequence
  Description of Artificial Sequence: Synthetic peptide
IYYSGST

SEQ ID NO: 100 - protein, 15 aa, Artificial Sequence
  Description of Artificial Sequence: Synthetic peptide
ARGAWELSLGDWFDP

SEQ ID NO: 101 - protein, 9 aa, Artificial Sequence
  Description of Artificial Sequence: Synthetic peptide
SSNIGAGYD

SEQ ID NO: 102 - protein, 3 aa, Artificial Sequence
  Description of Artificial Sequence: Synthetic peptide
GNN

SEQ ID NO: 103 - protein, 12 aa, Artificial Sequence
  Description of Artificial Sequence: Synthetic peptide
QSYDSSLSVYVV

SEQ ID NO: 104 - protein, 8 aa, Artificial Sequence
  Description of Artificial Sequence: Synthetic peptide
GFTFGTSS

SEQ ID NO: 105 - protein, 8 aa, Artificial Sequence
  Description of Artificial Sequence: Synthetic peptide
ISFDGTEI

SEQ ID NO: 106 - protein, 15 aa, Artificial Sequence
  Description of Artificial Sequence: Synthetic peptide
AKGSGNIYFYSGMDV

SEQ ID NO: 107 - protein, 6 aa, Artificial Sequence
  Description of Artificial Sequence: Synthetic peptide
QSISGW

SEQ ID NO: 108 - protein, 3 aa, Artificial Sequence
  Description of Artificial Sequence: Synthetic peptide
ETS

SEQ ID NO: 109 - protein, 9 aa, Artificial Sequence
  Description of Artificial Sequence: Synthetic peptide
QQYYSYPLT

SEQ ID NO: 110 - protein, 8 aa, Artificial Sequence
  Description of Artificial Sequence: Synthetic peptide
GYTLTELS

SEQ ID NO: 111 - protein, 8 aa, Artificial Sequence
  Description of Artificial Sequence: Synthetic peptide
FDPEDGET

SEQ ID NO: 112 - protein, 19 aa, Artificial Sequence
  Description of Artificial Sequence: Synthetic peptide
ATGVPAAIGVYYYYYYMDV

SEQ ID NO: 113 - protein, 11 aa, Artificial Sequence
  Description of Artificial Sequence: Synthetic peptide
QSLLYSNGYNY

SEQ ID NO: 114 - protein, 3 aa, Artificial Sequence
  Description of Artificial Sequence: Synthetic peptide
LGS

SEQ ID NO: 115 - protein, 9 aa, Artificial Sequence
  Description of Artificial Sequence: Synthetic peptide
MQALQSPVT

SEQ ID NO: 116 - protein, 8 aa, Artificial Sequence
  Description of Artificial Sequence: Synthetic peptide
GYTLTELS

SEQ ID NO: 117 - protein, 8 aa, Artificial Sequence
  Description of Artificial Sequence: Synthetic peptide
FDPEDGET

SEQ ID NO: 118 - protein, 20 aa, Artificial Sequence
  Description of Artificial Sequence: Synthetic peptide
ATDSRDGPAARGGYYYYMDV

SEQ ID NO: 119 - protein, 11 aa, Artificial Sequence
  Description of Artificial Sequence: Synthetic peptide
QSLLYINGYNY

SEQ ID NO: 120 - protein, 3 aa, Artificial Sequence
  Description of Artificial Sequence: Synthetic peptide
LGS

SEQ ID NO: 121 - protein, 9 aa, Artificial Sequence
  Description of Artificial Sequence: Synthetic peptide
MQALQTPPT

SEQ ID NO: 122 - protein, 8 aa, Artificial Sequence
  Description of Artificial Sequence: Synthetic peptide
GGTFSSYA

SEQ ID NO: 123 - protein, 8 aa, Artificial Sequence
  Description of Artificial Sequence: Synthetic peptide
IIPIFGTA

SEQ ID NO: 124 - protein, 20 aa, Artificial Sequence
  Description of Artificial Sequence: Synthetic peptide
ARDAYYYDSSGYYNPDAFDI

SEQ ID NO: 125 - protein, 11 aa, Artificial Sequence
  Description of Artificial Sequence: Synthetic peptide
QSLLHSNGYNY

SEQ ID NO: 126 - protein, 3 aa, Artificial Sequence
  Description of Artificial Sequence: Synthetic peptide
LGS

SEQ ID NO: 127 - protein, 9 aa, Artificial Sequence
  Description of Artificial Sequence: Synthetic peptide
MQGLQTPRT

SEQ ID NO: 128 - protein, 8 aa, Artificial Sequence
  Description of Artificial Sequence: Synthetic peptide
GGTFSSSA

SEQ ID NO: 129 - protein, 8 aa, Artificial Sequence
  Description of Artificial Sequence: Synthetic peptide
IIPIYGIT

SEQ ID NO: 130 - protein, 22 aa, Artificial Sequence
  Description of Artificial Sequence: Synthetic peptide
ARDDTARRVRGVPYYYYYAMDV

SEQ ID NO: 131 - protein, 6 aa, Artificial Sequence
  Description of Artificial Sequence: Synthetic peptide
QDIDDD

SEQ ID NO: 132 - protein, 3 aa, Artificial Sequence
  Description of Artificial Sequence: Synthetic peptide
EAS

SEQ ID NO: 133 - protein, 9 aa, Artificial Sequence
  Description of Artificial Sequence: Synthetic peptide
LQHDNLPLT

SEQ ID NO: 134 - protein, 8 aa, Artificial Sequence
  Description of Artificial Sequence: Synthetic peptide
GYTLTELS

SEQ ID NO: 135 - protein, 8 aa, Artificial Sequence
  Description of Artificial Sequence: Synthetic peptide
FDPEDGET

SEQ ID NO: 136 - protein, 19 aa, Artificial Sequence
  Description of Artificial Sequence: Synthetic peptide
ATEDPGPVAGPYYYYGMDV

SEQ ID NO: 137 - protein, 11 aa, Artificial Sequence
  Description of Artificial Sequence: Synthetic peptide
QSLLYINGYHY

SEQ ID NO: 138 - protein, 3 aa, Artificial Sequence
  Description of Artificial Sequence: Synthetic peptide
LGS

SEQ ID NO: 139 - protein, 9 aa, Artificial Sequence
  Description of Artificial Sequence: Synthetic peptide
MQALQTPPT

SEQ ID NO: 140 - protein, 8 aa, Artificial Sequence
  Description of Artificial Sequence: Synthetic peptide
GGTFSSSA

SEQ ID NO: 141 - protein, 8 aa, Artificial Sequence
  Description of Artificial Sequence: Synthetic peptide
IIPIYGIT

SEQ ID NO: 142 - protein, 22 aa, Artificial Sequence
  Description of Artificial Sequence: Synthetic peptide
ARDDTARRVRGVPYYYYYAMDV

SEQ ID NO: 143 - protein, 12 aa, Artificial Sequence
  Description of Artificial Sequence: Synthetic peptide
QSLLDSDDGNTY

SEQ ID NO: 144 - protein, 3 aa, Artificial Sequence
  Description of Artificial Sequence: Synthetic peptide
TLS

SEQ ID NO: 145 - protein, 9 aa, Artificial Sequence
  Description of Artificial Sequence: Synthetic peptide
MQRLQFPLT

SEQ ID NO: 146 - protein, 8 aa, Artificial Sequence
  Description of Artificial Sequence: Synthetic peptide
GYTLTELS

SEQ ID NO: 147 - protein, 8 aa, Artificial Sequence
  Description of Artificial Sequence: Synthetic peptide
FDPEDGET

SEQ ID NO: 148 - protein, 19 aa, Artificial Sequence
  Description of Artificial Sequence: Synthetic peptide
ATGVPAAIGVYYYYYYMDV

SEQ ID NO: 149 - protein, 11 aa, Artificial Sequence
  Description of Artificial Sequence: Synthetic peptide
QSLLYRNGYNY

SEQ ID NO: 150 - protein, 3 aa, Artificial Sequence
  Description of Artificial Sequence: Synthetic peptide
WGS

SEQ ID NO: 151 - protein, 9 aa, Artificial Sequence
  Description of Artificial Sequence: Synthetic peptide
MQAVQNPPT

SEQ ID NO: 152 - protein, 8 aa, Artificial Sequence
  Description of Artificial Sequence: Synthetic peptide
GGTFSSSA

SEQ ID NO: 153 - protein, 8 aa, Artificial Sequence
  Description of Artificial Sequence: Synthetic peptide
IIPIYGIT

SEQ ID NO: 154 - protein, 22 aa, Artificial Sequence
  Description of Artificial Sequence: Synthetic peptide
ARDDTARRVRGVPYYYYYAMDV

SEQ ID NO: 155 - protein, 6 aa, Artificial Sequence
  Description of Artificial Sequence: Synthetic peptide
QTMNNY

SEQ ID NO: 156 - protein, 3 aa, Artificial Sequence
  Description of Artificial Sequence: Synthetic peptide
DAS

SEQ ID NO: 157 - protein, 10 aa, Artificial Sequence
  Description of Artificial Sequence: Synthetic peptide
QQYGDWLPIT

SEQ ID NO: 158 - protein, 8 aa, Artificial Sequence
  Description of Artificial Sequence: Synthetic peptide
GYTLTELS

SEQ ID NO: 159 - protein, 8 aa, Artificial Sequence
  Description of Artificial Sequence: Synthetic peptide
FDPEDGET

SEQ ID NO: 160 - protein, 17 aa, Artificial Sequence
  Description of Artificial Sequence: Synthetic peptide
ATAFPEATISYYYYMDV

SEQ ID NO: 161 - protein, 11 aa, Artificial Sequence
  Description of Artificial Sequence: Synthetic peptide
QSLLYRNGYNY

SEQ ID NO: 162 - protein, 3 aa, Artificial Sequence
  Description of Artificial Sequence: Synthetic peptide
WGS

SEQ ID NO: 163 - protein, 9 aa, Artificial Sequence
  Description of Artificial Sequence: Synthetic peptide
MQAVQNPPT

SEQ ID NO: 164 - protein, 8 aa, Artificial Sequence
  Description of Artificial Sequence: Synthetic peptide
GGTFSSSA

SEQ ID NO: 165 - protein, 8 aa, Artificial Sequence
  Description of Artificial Sequence: Synthetic peptide
IIPIYGIT

SEQ ID NO: 166 - protein, 22 aa, Artificial Sequence
  Description of Artificial Sequence: Synthetic peptide
ARDDTARRVRGVPYYYYYAMDV

SEQ ID NO: 167 - protein, 12 aa, Artificial Sequence
  Description of Artificial Sequence: Synthetic peptide
RSLLDSDDGNTH

SEQ ID NO: 168 - protein, 3 aa, Artificial Sequence
  Description of Artificial Sequence: Synthetic peptide
SLS

SEQ ID NO: 169 - protein, 9 aa, Artificial Sequence
  Description of Artificial Sequence: Synthetic peptide
MQRKEFPLT

SEQ ID NO: 170 - protein, 8 aa, Artificial Sequence
  Description of Artificial Sequence: Synthetic peptide
GGTFSSYA

SEQ ID NO: 171 - protein, 8 aa, Artificial Sequence
  Description of Artificial Sequence: Synthetic peptide
IIPIFGTA

SEQ ID NO: 172 - protein, 21 aa, Artificial Sequence
  Description of Artificial Sequence: Synthetic peptide
ARGPWYYDSSGYSSYAYYMDV

SEQ ID NO: 173 - protein, 11 aa, Artificial Sequence
  Description of Artificial Sequence: Synthetic peptide
QSLLHSDGYNY

SEQ ID NO: 174 - protein, 3 aa, Artificial Sequence
  Description of Artificial Sequence: Synthetic peptide
LGS

SEQ ID NO: 175 - protein, 10 aa, Artificial Sequence
  Description of Artificial Sequence: Synthetic peptide
MQALHTPGVT

SEQ ID NO: 176 - protein, 120 aa, Artificial Sequence
  Description of Artificial Sequence: Synthetic polypeptide
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEVSSPYGMDVWGQGTTVTVSS

SEQ ID NO: 177 - protein, 8 aa, Artificial Sequence
  Description of Artificial Sequence: Synthetic peptide
GGTFSSYA

SEQ ID NO: 178 - protein, 8 aa, Artificial Sequence
  Description of Artificial Sequence: Synthetic peptide
IIPIFGTA

SEQ ID NO: 179 - protein, 13 aa, Artificial Sequence
  Description of Artificial Sequence: Synthetic peptide
AREEVSSPYGMDV

SEQ ID NO: 180 - protein, 450 aa, Artificial Sequence
  Description of Artificial Sequence: Synthetic polypeptide
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEVSSPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 111 aa, Artificial Sequence
  Description of Artificial Sequence: Synthetic polypeptide
QAVVTQEPSLTVSPGGTVTLTCGTSTGAVTSGHYPYWFQQKPGQAPKTLIYDTGNKHSWTPARFSGSLLGGKAALTLSGAQPEDEADYYCLLSYSGASWVFGGGTKLTVLG

SEQ ID NO: 182 - protein, 9 aa, Artificial Sequence
  Description of Artificial Sequence: Synthetic peptide
TGAVTSGHY

SEQ ID NO: 183 - protein, 3 aa, Artificial Sequence
  Description of Artificial Sequence: Synthetic peptide
DTG

SEQ ID NO: 184 - protein, 10 aa, Artificial Sequence
  Description of Artificial Sequence: Synthetic peptide
LLSYSGASWV

SEQ ID NO: 185 - protein, 216 aa, Artificial Sequence
  Description of Artificial Sequence: Synthetic polypeptide
QAVVTQEPSLTVSPGGTVTLTCGTSTGAVTSGHYPYWFQQKPGQAPKTLIYDTGNKHSWTPARFSGSLLGGKAALTLSGAQPEDEADYYCLLSYSGASWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 186 - protein, 121 aa, Artificial Sequence
  Description of Artificial Sequence: Synthetic polypeptide
QVQLVQSGAEVKKPGASVKVSCKVSGFSLSHFSMHWVRQVPGKGLEWLGGFDPEEGGTIPAQKFQGRLTMTEDTSTETAYMELSSLRSEDTAVYYCATGIWYSSGWPVDYWGPGTLVTVSS

SEQ ID NO: 187 - protein, 8 aa, Artificial Sequence
  Description of Artificial Sequence: Synthetic peptide
GFSLSHFS

SEQ ID NO: 188 - protein, 8 aa, Artificial Sequence
  Description of Artificial Sequence: Synthetic peptide
FDPEEGGT

SEQ ID NO: 189 - protein, 14 aa, Artificial Sequence
  Description of Artificial Sequence: Synthetic peptide
ATGIWYSSGWPVDY

SEQ ID NO: 190 - protein, 458 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGPWYYDSSGYSSYAYYMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 113 aa, Artificial Sequence
  Description of Artificial Sequence: Synthetic polypeptide
DVVMTQSPLSLPVTPGGPASISCRSSQSLLDSSGYNYVDWYLQKPGQSPQLLISLGSDRASGVPDRFSGSGSGTDFTLKISRVEAEDVGIYYCMQALQTPITFGQGTRLEIKR

SEQ ID NO: 192 - protein, 11 aa, Artificial Sequence
  Description of Artificial Sequence: Synthetic peptide
QSLLDSSGYNY

SEQ ID NO: 193 - protein, 3 aa, Artificial Sequence
  Description of Artificial Sequence: Synthetic peptide
LGS

SEQ ID NO: 194 - protein, 9 aa, Artificial Sequence
  Description of Artificial Sequence: Synthetic peptide
MQALQTPIT

SEQ ID NO: 195 - protein, 219 aa, Artificial Sequence
  Description of Artificial Sequence: Synthetic polypeptide
DVVMTQSPLSLPVTPGGPASISCRSSQSLLDSSGYNYVDWYLQKPGQSPQLLISLGSDRASGVPDRFSGSGSGTDFTLKISRVEAEDVGIYYCMQALQTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 196 - protein, 125 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATVSRVRGVINYYYYMDVWGKGTTVTVSS

SEQ ID NO: 197 - protein, 8 aa, Artificial Sequence
  Description of Artificial Sequence: Synthetic peptide
GYTLTELS

SEQ ID NO: 198 - protein, 8 aa, Artificial Sequence
  Description of Artificial Sequence: Synthetic peptide
FDPEDGET

SEQ ID NO: 199 - protein, 18 aa, Artificial Sequence
  Description of Artificial Sequence: Synthetic peptide
ATVSRVRGVINYYYYMDV

SEQ ID NO: 200 - protein, 455 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATVSRVRGVINYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 113 aa, Artificial Sequence
  Description of Artificial Sequence: Synthetic polypeptide
DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKR

SEQ ID NO: 202 - protein, 11 aa, Artificial Sequence
  Description of Artificial Sequence: Synthetic peptide
QSLLYRNGNNY

SEQ ID NO: 203 - protein, 3 aa, Artificial Sequence
  Description of Artificial Sequence: Synthetic peptide
LGS

SEQ ID NO: 204 - protein, 9 aa, Artificial Sequence
  Description of Artificial Sequence: Synthetic peptide
MQALQTPPT

SEQ ID NO: 205 - protein, 219 aa, Artificial Sequence
  Description of Artificial Sequence: Synthetic polypeptide
DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 206 - protein, 120 aa, Artificial Sequence
  Description of Artificial Sequence: Synthetic polypeptide
QVQLVQSGAEVRRPGSSVRVSCKPSGGTFGTYAFTWVRQAPGQGLEWMGGITPISATINRAQNLQDRLTITADESTTTVHMDLTSLRSEDTAVYYCARGFEYSDGLLDDWGQGTLVTVSS

SEQ ID NO: 207 - protein, 8 aa, Artificial Sequence
  Description of Artificial Sequence: Synthetic peptide
GGTFGTYA

SEQ ID NO: 208 - protein, 8 aa, Artificial Sequence
  Description of Artificial Sequence: Synthetic peptide
ITPISATI

SEQ ID NO: 209 - protein, 13 aa, Artificial Sequence
  Description of Artificial Sequence: Synthetic peptide
ARGFEYSDGLLDD

SEQ ID NO: 210 - protein, 450 aa, Artificial Sequence
  Description of Artificial Sequence: Synthetic polypeptide
QVQLVQSGAEVRRPGSSVRVSCKPSGGTFGTYAFTWVRQAPGQGLEWMGGITPISATINRAQNLQDRLTITADESTTTVHMDLTSLRSEDTAVYYCARGFEYSDGLLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 114 aa, Artificial Sequence
  Description of Artificial Sequence: Synthetic polypeptide
DIVMTQTPLSLPVIPGEPASISCRSSQSLFYSDDGNTYLDWYLQKPGQSPQLLIYRLSHRASGVPDRFSGSGSGTDFTLKISRVEAEDVGVYYCMQHMEFPLTFGGGTKVEIKR

SEQ ID NO: 212 - protein, 12 aa, Artificial Sequence
  Description of Artificial Sequence: Synthetic peptide
QSLFYSDDGNTY

SEQ ID NO: 213 - protein, 3 aa, Artificial Sequence
  Description of Artificial Sequence: Synthetic peptide
RLS

SEQ ID NO: 214 - protein, 9 aa, Artificial Sequence
  Description of Artificial Sequence: Synthetic peptide
MQHMEFPLT

SEQ ID NO: 215 - protein, 220 aa, Artificial Sequence
  Description of Artificial Sequence: Synthetic polypeptide
DIVMTQTPLSLPVIPGEPASISCRSSQSLFYSDDGNTYLDWYLQKPGQSPQLLIYRLSHRASGVPDRFSGSGSGTDFTLKISRVEAEDVGVYYCMQHMEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - protein, 117 aa, Artificial Sequence
  Description of Artificial Sequence: Synthetic polypeptide
QVQLQESGPGLVKPSGTLSLTCVVSSGSISSTNWWTWVRQPPGKGLEWIGEIYHSGSTSYNSSLKSRVTISEDKSKNQISLRLSSVTAADTAVYYCARVGPAAIYYWGQGTLVTVSS

SEQ ID NO: 217 - protein, 9 aa, Artificial Sequence
  Description of Artificial Sequence: Synthetic peptide
SGSISSTNW

SEQ ID NO: 218 - protein, 7 aa, Artificial Sequence
  Description of Artificial Sequence: Synthetic peptide
IYHSGST

SEQ ID NO: 219 - protein, 10 aa, Artificial Sequence
  Description of Artificial Sequence: Synthetic peptide
ARVGPAAIYY

SEQ ID NO: 220 - protein, 447 aa, Artificial Sequence
  Description of Artificial Sequence: Synthetic polypeptide
QVQLQESGPGLVKPSGTLSLTCVVSSGSISSTNWWTWVRQPPGKGLEWIGEIYHSGSTSYNSSLKSRVTISEDKSKNQISLRLSSVTAADTAVYYCARVGPAAIYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 111 aa, Artificial Sequence
  Description of Artificial Sequence: Synthetic polypeptide
QAGLTQPPSVSKGLRQTATLTCTGNSNNVGYEGAAWLQQHQGHAPKLLLYRNNNRPSGISKRFSASRSGNTASLTITGLQPEDEADYYCSAWDSSLNAVVFGGGTQLTVLG

SEQ ID NO: 222 - protein, 8 aa, Artificial Sequence
  Description of Artificial Sequence: Synthetic peptide
SNNVGYEG

SEQ ID NO: 223 - protein, 3 aa, Artificial Sequence
  Description of Artificial Sequence: Synthetic peptide
RNN

SEQ ID NO: 224 - protein, 11 aa, Artificial Sequence
  Description of Artificial Sequence: Synthetic peptide
SAWDSSLNAVV

SEQ ID NO: 225 - protein, 216 aa, Artificial Sequence
  Description of Artificial Sequence: Synthetic polypeptide
QAGLTQPPSVSKGLRQTATLTCTGNSNNVGYEGAAWLQQHQGHAPKLLLYRNNNRPSGISKRFSASRSGNTASLTITGLQPEDEADYYCSAWDSSLNAVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 226 - protein, 128 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAKPGIAVAGQNYYYYYMDVWGKGTTVTVSS

SEQ ID NO: 227 - protein, 8 aa, Artificial Sequence
  Description of Artificial Sequence: Synthetic peptide
GYTLTELS

SEQ ID NO: 228 - protein, 8 aa, Artificial Sequence
  Description of Artificial Sequence: Synthetic peptide
FDPEDGET

SEQ ID NO: 229 - protein, 21 aa, Artificial Sequence
  Description of Artificial Sequence: Synthetic peptide
ATAKPGIAVAGQNYYYYYMDV

SEQ ID NO: 230 - protein, 458 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAKPGIAVAGQNYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 113 aa, Artificial Sequence; identical to SEQ ID NO: 201
  Description of Artificial Sequence: Synthetic polypeptide

SEQ ID NO: 232 - protein, 11 aa, Artificial Sequence
  Description of Artificial Sequence: Synthetic peptide
QSLLYRNGNNY

SEQ ID NO: 233 - protein, 3 aa, Artificial Sequence
  Description of Artificial Sequence: Synthetic peptide
LGS

SEQ ID NO: 234 - protein, 9 aa, Artificial Sequence
  Description of Artificial Sequence: Synthetic peptide
MQALQTPPT

SEQ ID NO: 235 - protein, 219 aa, Artificial Sequence; identical to SEQ ID NO: 205
  Description of Artificial Sequence: Synthetic polypeptide

SEQ ID NO: 236 - protein, 124 aa, Artificial Sequence
  Description of Artificial Sequence: Synthetic polypeptide
EVQLVESGGGLVQPGRSLRLSCAASGFTFSSYAMHWVRQAPGKGLEWVAVISYDGSNKYYADSVKGRFTISRDNSKNTLYLQMNSLRAEDTAVYYCASSPIGYSYGYWGGMDVWGQGTTVTVSS

SEQ ID NO: 237 - protein, 8 aa, Artificial Sequence
  Description of Artificial Sequence: Synthetic peptide
GFTFSSYA

SEQ ID NO: 238 - protein, 8 aa, Artificial Sequence
  Description of Artificial Sequence: Synthetic peptide
ISYDGSNK

SEQ ID NO: 239 - protein, 17 aa, Artificial Sequence
  Description of Artificial Sequence: Synthetic peptide
ASSPIGYSYGYWGGMDV

SEQ ID NO: 240 - protein, 454 aa, Artificial Sequence
  Description of Artificial Sequence: Synthetic polypeptide
EVQLVESGGGLVQPGRSLRLSCAASGFTFSSYAMHWVRQAPGKGLEWVAVISYDGSNKYYADSVKGRFTISRDNSKNTLYLQMNSLRAEDTAVYYCASSPIGYSYGYWGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 116 aa, Artificial Sequence
  Description of Artificial Sequence: Synthetic polypeptide
QAVLTQPASLSASPGASASLTCTLRSGIDVRTNKIFWYQVKPGSPPQHLLTFQSDSDKQQGSGVPSRFSGSKDASANAGILIISGLQSEDEADYYCLIWHTSGWVFGGGTQLTVLG

SEQ ID NO: 242 - protein, 9 aa, Artificial Sequence
  Description of Artificial Sequence: Synthetic peptide
SGIDVRTNK

SEQ ID NO: 243 - protein, 7 aa, Artificial Sequence
  Description of Artificial Sequence: Synthetic peptide
FQSDSDK

SEQ ID NO: 244 - protein, 9 aa, Artificial Sequence
  Description of Artificial Sequence: Synthetic peptide
LIWHTSGWV

SEQ ID NO: 245 - protein, 221 aa, Artificial Sequence
  Description of Artificial Sequence: Synthetic polypeptide
QAVLTQPASLSASPGASASLTCTLRSGIDVRTNKIFWYQVKPGSPPQHLLTFQSDSDKQQGSGVPSRFSGSKDASANAGILIISGLQSEDEADYYCLIWHTSGWVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 246 - protein, 124 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGPAAAGVGYYYYMDVWGKGTTVTVSS

SEQ ID NO: 247 - protein, 8 aa, Artificial Sequence
  Description of Artificial Sequence: Synthetic peptide
GYTLTELS

SEQ ID NO: 248 - protein, 8 aa, Artificial Sequence
  Description of Artificial Sequence: Synthetic peptide
FDPEDGET

SEQ ID NO: 249 - protein, 17 aa, Artificial Sequence
  Description of Artificial Sequence: Synthetic peptide
ATGPAAAGVGYYYYMDV

SEQ ID NO: 250 - protein, 454 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGPAAAGVGYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 113 aa, Artificial Sequence
  Description of Artificial Sequence: Synthetic polypeptide
DVVMTQSPLSLPVTPGEPASISCRSSQSLLYRNGYNYLDWYLQKPGQSPQLLIYLGSNRASGVPDRFSGSGSGTDFTLKISRVEAEDVGVYYCMQALQTPPTFGQGTKVEIKR

SEQ ID NO: 252 - protein, 11 aa, Artificial Sequence
  Description of Artificial Sequence: Synthetic peptide
QSLLYRNGYNY

SEQ ID NO: 253 - protein, 3 aa, Artificial Sequence
  Description of Artificial Sequence: Synthetic peptide
LGS

SEQ ID NO: 254 - protein, 9 aa, Artificial Sequence
  Description of Artificial Sequence: Synthetic peptide
MQALQTPPT

SEQ ID NO: 255 - protein, 219 aa, Artificial Sequence
  Description of Artificial Sequence: Synthetic polypeptide
DVVMTQSPLSLPVTPGEPASISCRSSQSLLYRNGYNYLDWYLQKPGQSPQLLIYLGSNRASGVPDRFSGSGSGTDFTLKISRVEAEDVGVYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 256 - protein, 127 aa, Artificial Sequence
  Description of Artificial Sequence: Synthetic polypeptide
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDVMVYCSSTSCYFYGMDVWGQGTTVTVSS

SEQ ID NO: 257 - protein, 8 aa, Artificial Sequence
  Description of Artificial Sequence: Synthetic peptide
GFTFSSYA

SEQ ID NO: 258 - protein, 8 aa, Artificial Sequence
  Description of Artificial Sequence: Synthetic peptide
ISYDGSNK

SEQ ID NO: 259 - protein, 20 aa, Artificial Sequence
  Description of Artificial Sequence: Synthetic peptide
ARDVMVYCSSTSCYFYGMDV

SEQ ID NO: 260 - protein, 457 aa, Artificial Sequence
  Description of Artificial Sequence: Synthetic polypeptide
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDVMVYCSSTSCYFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 261 - protein, 108 aa, Artificial Sequence
  Description of Artificial Sequence: Synthetic polypeptide
DIQMTQSPSSLSASVGDRVTVTCQASQDIRDYLNWYQKKPGKAPKLLIYDASNLEAGVPSRFSGSGSGTDFTFTISGLQPEDVATYYCQQFENLPITFGQGTRLEIKR

SEQ ID NO: 262 - protein, 6 aa, Artificial Sequence
  Description of Artificial Sequence: Synthetic peptide
QDIRDY

SEQ ID NO: 263 - protein, 3 aa, Artificial Sequence
  Description of Artificial Sequence: Synthetic peptide
DAS

SEQ ID NO: 264 - protein, 9 aa, Artificial Sequence
  Description of Artificial Sequence: Synthetic peptide
QQFENLPIT

SEQ ID NO: 265 - protein, 214 aa, Artificial Sequence
  Description of Artificial Sequence: Synthetic polypeptide
DIQMTQSPSSLSASVGDRVTVTCQASQDIRDYLNWYQKKPGKAPKLLIYDASNLEAGVPSRFSGSGSGTDFTFTISGLQPEDVATYYCQQFENLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 266 - protein, 125 aa, Artificial Sequence
  Description of Artificial Sequence: Synthetic polypeptide
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSSGFNYYYYYMDVWGKGTTVTVSS

SEQ ID NO: 267 - protein, 8 aa, Artificial Sequence
  Description of Artificial Sequence: Synthetic peptide
GYTLTELS

SEQ ID NO: 268 - protein, 8 aa, Artificial Sequence
  Description of Artificial Sequence: Synthetic peptide
FDPEDGET

SEQ ID NO: 269 - protein, 18 aa, Artificial Sequence
  Description of Artificial Sequence: Synthetic peptide
ATGGYSSGFNYYYYYMDV

SEQ ID NO: 270 - protein, 455 aa, Artificial Sequence
  Description of Artificial Sequence: Synthetic polypeptide
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSSGFNYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 271 - protein, 113 aa, Artificial Sequence; identical to SEQ ID NO: 201
  Description of Artificial Sequence: Synthetic polypeptide

SEQ ID NO: 272 - protein, 11 aa, Artificial Sequence
  Description of Artificial Sequence: Synthetic peptide
QSLLYRNGNNY

SEQ ID NO: 273 - protein, 3 aa, Artificial Sequence
  Description of Artificial Sequence: Synthetic peptide
LGS

SEQ ID NO: 274 - protein, 9 aa, Artificial Sequence
  Description of Artificial Sequence: Synthetic peptide
MQALQTPPT

SEQ ID NO: 275 - protein, 219 aa, Artificial Sequence; identical to SEQ ID NO: 205
  Description of Artificial Sequence: Synthetic polypeptide

SEQ ID NO: 276 - protein, 121 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVTTYYYYGMDVWGQGTTVTVSS

SEQ ID NO: 277 - protein, 8 aa, Artificial Sequence
  Description of Artificial Sequence: Synthetic peptide
GYTLTELS

SEQ ID NO: 278 - protein, 8 aa, Artificial Sequence
  Description of Artificial Sequence: Synthetic peptide
FDPEDGET

SEQ ID NO: 279 - protein, 14 aa, Artificial Sequence
  Description of Artificial Sequence: Synthetic peptide
ATGVTTYYYYGMDV

SEQ ID NO: 280 - protein, 451 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVTTYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - protein, 113 aa, Artificial Sequence
  Description of Artificial Sequence: Synthetic polypeptide
DVVMTQSPLSLPVTPGEPASISCRSSQSLLYSNGNNFLDWYLQKPGQSPRLLISLGSNRASGVPDRFSGSGSGTDFTLKISRVEAEDVGIYYCMQALQTPPTFGQGTKVEIKR

SEQ ID NO: 282 - protein, 11 aa, Artificial Sequence
  Description of Artificial Sequence: Synthetic peptide
QSLLYSNGNNF

SEQ ID NO: 283 - protein, 3 aa, Artificial Sequence
  Description of Artificial Sequence: Synthetic peptide
LGS

SEQ ID NO: 284 - protein, 9 aa, Artificial Sequence
  Description of Artificial Sequence: Synthetic peptide
MQALQTPPT

SEQ ID NO: 285 - protein, 219 aa, Artificial Sequence
  Description of Artificial Sequence: Synthetic polypeptide
DVVMTQSPLSLPVTPGEPASISCRSSQSLLYSNGNNFLDWYLQKPGQSPRLLISLGSNRASGVPDRFSGSGSGTDFTLKISRVEAEDVGIYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 286 - protein, 121 aa, Artificial Sequence
  Description of Artificial Sequence: Synthetic polypeptide
QITLKESGGGVVQPGGSLRLSCAASGFTFSSYGMHWVRQAPGKGLEWVAFIRYDGSNKYYADSVKGRFTISRDNSKNTLYLQMNSLRAEDTAVYYCARDLFDFWWDGMDVWGQGTTVTVSS

SEQ ID NO: 287 - protein, 8 aa, Artificial Sequence
  Description of Artificial Sequence: Synthetic peptide
GFTFSSYG

SEQ ID NO: 288 - protein, 8 aa, Artificial Sequence
  Description of Artificial Sequence: Synthetic peptide
IRYDGSNK

SEQ ID NO: 289 - protein, 14 aa, Artificial Sequence
  Description of Artificial Sequence: Synthetic peptide
ARDLFDFWWDGMDV

SEQ ID NO: 290 - protein, 451 aa, Artificial Sequence
  Description of Artificial Sequence: Synthetic polypeptide
QITLKESGGGVVQPGGSLRLSCAASGFTFSSYGMHWVRQAPGKGLEWVAFIRYDGSNKYYADSVKGRFTISRDNSKNTLYLQMNSLRAEDTAVYYCARDLFDFWWDGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 110 aa, Artificial Sequence
  Description of Artificial Sequence: Synthetic polypeptide
EIVLTQSPGTLSLSPGEKATLSCRVSQSVSSMYLAWYQQKPGQAPRLLIYGASYRATGIPDRFSGSGSGTDFNLTISRLEPEDFAVYYCQQYVSSPMYTFGLGTKLEIKR

SEQ ID NO: 292 - protein, 7 aa, Artificial Sequence
  Description of Artificial Sequence: Synthetic peptide
QSVSSMY

SEQ ID NO: 293 - protein, 3 aa, Artificial Sequence
  Description of Artificial Sequence: Synthetic peptide
GAS

SEQ ID NO: 294 - protein, 10 aa, Artificial Sequence
  Description of Artificial Sequence: Synthetic peptide
QQYVSSPMYT

SEQ ID NO: 295 - protein, 216 aa, Artificial Sequence
  Description of Artificial Sequence: Synthetic polypeptide
EIVLTQSPGTLSLSPGEKATLSCRVSQSVSSMYLAWYQQKPGQAPRLLIYGASYRATGIPDRFSGSGSGTDFNLTISRLEPEDFAVYYCQQYVSSPMYTFGLGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 122 aa, Artificial Sequence
  Description of Artificial Sequence: Synthetic polypeptide
QVQLVQSGAEVKKPGSSVKVSCKASGGTFNNYGISWVRQAPGKGLEWMGQIIPLFGTTKYAQKFQGRVTIAADEPTSTAYMELGSLRSEDTAIYYCARDRMAADGMAVFDYWGQGTLVTVSS

SEQ ID NO: 297 - protein, 8 aa, Artificial Sequence
  Description of Artificial Sequence: Synthetic peptide
GGTFNNYG

SEQ ID NO: 298 - protein, 8 aa, Artificial Sequence
  Description of Artificial Sequence: Synthetic peptide
IIPLFGTT

SEQ ID NO: 299 - protein, 15 aa, Artificial Sequence
  Description of Artificial Sequence: Synthetic peptide
ARDRMAADGMAVFDY

SEQ ID NO: 300 - protein, 452 aa, Artificial Sequence
  Description of Artificial Sequence: Synthetic polypeptide
QVQLVQSGAEVKKPGSSVKVSCKASGGTFNNYGISWVRQAPGKGLEWMGQIIPLFGTTKYAQKFQGRVTIAADEPTSTAYMELGSLRSEDTAIYYCARDRMAADGMAVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 111 aa, Artificial Sequence
  Description of Artificial Sequence: Synthetic polypeptide
QSVLTQPPSVSGTPGQKVIISCSGSSSNIGRHFVFWYQQLPGTAPKLLIYKNDERPSGVPDRFSGSKSGTSASLAVSGLRSEDEADYYCSSWDAALNGVVFGGGTKLTVLG

SEQ ID NO: 302 - protein, 8 aa, Artificial Sequence
  Description of Artificial Sequence: Synthetic peptide
SSNIGRHF

SEQ ID NO: 303 - protein, 3 aa, Artificial Sequence
  Description of Artificial Sequence: Synthetic peptide
KND

SEQ ID NO: 304 - protein, 11 aa, Artificial Sequence
  Description of Artificial Sequence: Synthetic peptide
SSWDAALNGVV

SEQ ID NO: 305 - protein, 216 aa, Artificial Sequence
  Description of Artificial Sequence: Synthetic polypeptide
QSVLTQPPSVSGTPGQKVIISCSGSSSNIGRHFVFWYQQLPGTAPKLLIYKNDERPSGVPDRFSGSKSGTSASLAVSGLRSEDEADYYCSSWDAALNGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 306 - protein, 126 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVPMVRGARRYYYYMDVWGKGTTVTVSS

SEQ ID NO: 307 - protein, 8 aa, Artificial Sequence
  Description of Artificial Sequence: Synthetic peptide
GYTLTELS

SEQ ID NO: 308 - protein, 8 aa, Artificial Sequence
  Description of Artificial Sequence: Synthetic peptide
FDPEDGET

SEQ ID NO: 309 - protein, 19 aa, Artificial Sequence
  Description of Artificial Sequence: Synthetic peptide
ATEVPMVRGARRYYYYMDV

SEQ ID NO: 310 - protein, 456 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVPMVRGARRYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 113 aa, Artificial Sequence
  Description of Artificial Sequence: Synthetic polypeptide
DVVMTQSPLFLAVTPGEPASISCRSSQTLLYINENNYLDWYVQKPGQSPQLLIYLGSTRASGVPDRFSGGGSGTDFTLTISRVEAEDVGLYYCMQGLQTPPTFGQGTRLEIKR

SEQ ID NO: 312 - protein, 11 aa, Artificial Sequence
  Description of Artificial Sequence: Synthetic peptide
QTLLYINENNY

SEQ ID NO: 313 - protein, 3 aa, Artificial Sequence
  Description of Artificial Sequence: Synthetic peptide
LGS

SEQ ID NO: 314 - protein, 9 aa, Artificial Sequence
  Description of Artificial Sequence: Synthetic peptide
MQGLQTPPT

SEQ ID NO: 315 - protein, 219 aa, Artificial Sequence
  Description of Artificial Sequence: Synthetic polypeptide
DVVMTQSPLFLAVTPGEPASISCRSSQTLLYINENNYLDWYVQKPGQSPQLLIYLGSTRASGVPDRFSGGGSGTDFTLTISRVEAEDVGLYYCMQGLQTPPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 316 - protein, 123 aa, Artificial Sequence
  Description of Artificial Sequence: Synthetic polypeptide
QVQLQESGPGLVKSSETLSLTCSVSGGSISNSNYYWGWIRQPPGKGLEWIGGIYYSGSTYYNPSLESRVTISEDTSKNQISLKLSSVTAADTAVYYCARGAWELSLGDWFDPWGPGTLVTVSS

SEQ ID NO: 317 - protein, 10 aa, Artificial Sequence
  Description of Artificial Sequence: Synthetic peptide
GGSISNSNYY

SEQ ID NO: 318 - protein, 7 aa, Artificial Sequence
  Description of Artificial Sequence: Synthetic peptide
IYYSGST

SEQ ID NO: 319 - protein, 15 aa, Artificial Sequence
  Description of Artificial Sequence: Synthetic peptide
ARGAWELSLGDWFDP

SEQ ID NO: 320 - protein, 453 aa, Artificial Sequence
  Description of Artificial Sequence: Synthetic polypeptide
QVQLQESGPGLVKSSETLSLTCSVSGGSISNSNYYWGWIRQPPGKGLEWIGGIYYSGSTYYNPSLESRVTISEDTSKNQISLKLSSVTAADTAVYYCARGAWELSLGDWFDPWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 113 aa, Artificial Sequence
  Description of Artificial Sequence: Synthetic polypeptide
QSVLTQPPSVSGAPGQRVTISCTGSSSNIGAGYDIQWYQQLPGTAPKLLIYGNNNRPSGVPDRFSGSRSGTSASLAITGLQAEDEADYYCQSYDSSLSVYVVFGGGTQLTVLG

SEQ ID NO: 322 - protein, 9 aa, Artificial Sequence
  Description of Artificial Sequence: Synthetic peptide
SSNIGAGYD

SEQ ID NO: 323 - protein, 3 aa, Artificial Sequence
  Description of Artificial Sequence: Synthetic peptide
GNN

SEQ ID NO: 324 - protein, 12 aa, Artificial Sequence
  Description of Artificial Sequence: Synthetic peptide
QSYDSSLSVYVV

SEQ ID NO: 325 - protein, 218 aa, Artificial Sequence
  Description of Artificial Sequence: Synthetic polypeptide
QSVLTQPPSVSGAPGQRVTISCTGSSSNIGAGYDIQWYQQLPGTAPKLLIYGNNNRPSGVPDRFSGSRSGTSASLAITGLQAEDEADYYCQSYDSSLSVYVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 326 - protein, 122 aa, Artificial Sequence
  Description of Artificial Sequence: Synthetic polypeptide
EVQLVESGGGVVKPGGSLRLSCAASGFTFGTSSMNWVRQAPGKGLEWVAVISFDGTEIHYADSVKGRFTISRDNSKSTVFLQMNSLRPDDTALYYCAKGSGNIYFYSGMDVWGQGTTVTVSS

SEQ ID NO: 327 - protein, 8 aa, Artificial Sequence
  Description of Artificial Sequence: Synthetic peptide
GFTFGTSS

SEQ ID NO: 328 - protein, 8 aa, Artificial Sequence
  Description of Artificial Sequence: Synthetic peptide
ISFDGTEI

SEQ ID NO: 329 - protein, 15 aa, Artificial Sequence
  Description of Artificial Sequence: Synthetic peptide
AKGSGNIYFYSGMDV

SEQ ID NO: 330 - protein, 452 aa, Artificial Sequence
  Description of Artificial Sequence: Synthetic polypeptide
EVQLVESGGGVVKPGGSLRLSCAASGFTFGTSSMNWVRQAPGKGLEWVAVISFDGTEIHYADSVKGRFTISRDNSKSTVFLQMNSLRPDDTALYYCAKGSGNIYFYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 108 aa, Artificial Sequence
  Description of Artificial Sequence: Synthetic polypeptide
DIQMTQSPSTLSASVGDRVTITCRAGQSISGWLAWFQQKPGKAPNLLIYETSTLESGVPSRFSGSGSGTEYTLTISSLQPDDFATYYCQQYYSYPLTFGQGTKVEIKR

SEQ ID NO: 332 - protein, 6 aa, Artificial Sequence
  Description of Artificial Sequence: Synthetic peptide
QSISGW

SEQ ID NO: 333 - protein, 3 aa, Artificial Sequence
  Description of Artificial Sequence: Synthetic peptide
ETS

SEQ ID NO: 334 - protein, 9 aa, Artificial Sequence
  Description of Artificial Sequence: Synthetic peptide
QQYYSYPLT

SEQ ID NO: 335 - protein, 214 aa, Artificial Sequence
  Description of Artificial Sequence: Synthetic polypeptide
DIQMTQSPSTLSASVGDRVTITCRAGQSISGWLAWFQQKPGKAPNLLIYETSTLESGVPSRFSGSGSGTEYTLTISSLQPDDFATYYCQQYYSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - protein, 126 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYYMDVWGKGTTVTVSS

SEQ ID NO: 337 - protein, 8 aa, Artificial Sequence
  Description of Artificial Sequence: Synthetic peptide
GYTLTELS

SEQ ID NO: 338 - protein, 8 aa, Artificial Sequence
  Description of Artificial Sequence: Synthetic peptide
FDPEDGET

SEQ ID NO: 339 - protein, 19 aa, Artificial Sequence
  Description of Artificial Sequence: Synthetic peptide
ATGVPAAIGVYYYYYYMDV

SEQ ID NO: 340 - protein, 456 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 113 aa, Artificial Sequence
  Description of Artificial Sequence: Synthetic polypeptide
DVVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQSPVTFGGGTKVEIKR

SEQ ID NO: 342 - protein, 11 aa, Artificial Sequence
  Description of Artificial Sequence: Synthetic peptide
QSLLYSNGYNY

SEQ ID NO: 343 - protein, 3 aa, Artificial Sequence
  Description of Artificial Sequence: Synthetic peptide
LGS

SEQ ID NO: 344 - protein, 9 aa, Artificial Sequence
  Description of Artificial Sequence: Synthetic peptide
MQALQSPVT

SEQ ID NO: 345 - protein, 219 aa, Artificial Sequence
  Description of Artificial Sequence: Synthetic polypeptide
DVVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQSPVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 346 - protein, 127 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSRDGPAARGGYYYYMDVWGQGTTVTVSS

SEQ ID NO: 347 - protein, 8 aa, Artificial Sequence
  Description of Artificial Sequence: Synthetic peptide
GYTLTELS

SEQ ID NO: 348 - protein, 8 aa, Artificial Sequence
  Description of Artificial Sequence: Synthetic peptide
FDPEDGET

SEQ ID NO: 349 - protein, 20 aa, Artificial Sequence
  Description of Artificial Sequence: Synthetic peptide
ATDSRDGPAARGGYYYYMDV

SEQ ID NO: 350 - protein, 457 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSRDGPAARGGYYYYMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 113 aa, Artificial Sequence
  Description of Artificial Sequence: Synthetic polypeptide
DVVMTQSPLSLPVTLGQPASISCRSSQSLLYINGYNYLDWYLQKPGQSPQLLIYLGSNRASGVPDRFSGSGSGTDFTLKISRVEAEDVGVYYCMQALQTPPTFGQGTKVEIKR

SEQ ID NO: 352 - protein, 11 aa, Artificial Sequence
  Description of Artificial Sequence: Synthetic peptide
QSLLYINGYNY

SEQ ID NO: 353 - protein, 3 aa, Artificial Sequence
  Description of Artificial Sequence: Synthetic peptide
LGS

SEQ ID NO: 354 - protein, 9 aa, Artificial Sequence
  Description of Artificial Sequence: Synthetic peptide
MQALQTPPT

SEQ ID NO: 355 - protein, 219 aa, Artificial Sequence
  Description of Artificial Sequence: Synthetic polypeptide
DVVMTQSPLSLPVTLGQPASISCRSSQSLLYINGYNYLDWYLQKPGQSPQLLIYLGSNRASGVPDRFSGSGSGTDFTLKISRVEAEDVGVYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 356 - protein, 127 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDAYYYDSSGYYNPDAFDIWGQGTMVTVSS

SEQ ID NO: 357 - protein, 8 aa, Artificial Sequence
  Description of Artificial Sequence: Synthetic peptide
GGTFSSYA

SEQ ID NO: 358 - protein, 8 aa, Artificial Sequence
  Description of Artificial Sequence: Synthetic peptide
IIPIFGTA

SEQ ID NO: 359 - protein, 20 aa, Artificial Sequence
  Description of Artificial Sequence: Synthetic peptide
ARDAYYYDSSGYYNPDAFDI

SEQ ID NO: 360 - protein, 457 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDAYYYDSSGYYNPDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 113 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSSRASGVPDRFSGSVSGTDFTLKISRVEAEDVGVYYCMQGLQTPRTFGRGTKLEIKR

SEQ ID NO: 362 - protein, 11 aa, Artificial Sequence
  Description of Artificial Sequence: Synthetic peptide
QSLLHSNGYNY

SEQ ID NO: 363 - protein, 3 aa, Artificial Sequence
  Description of Artificial Sequence: Synthetic peptide
LGS

SEQ ID NO: 364 - protein, 9 aa, Artificial Sequence
  Description of Artificial Sequence: Synthetic peptide
MQGLQTPRT

SEQ ID NO: 365 - protein, 219 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSSRASGVPDRFSGSVSGTDFTLKISRVEAEDVGVYYCMQGLQTPRTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - protein, 129 aa, Artificial Sequence
  Description of Artificial Sequence: Synthetic polypeptide
QVQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSS

SEQ ID NO: 367 - protein, 8 aa, Artificial Sequence
  Description of Artificial Sequence: Synthetic peptide
GGTFSSSA

SEQ ID NO: 368 - protein, 8 aa, Artificial Sequence
  Description of Artificial Sequence: Synthetic peptide
IIPIYGIT

SEQ ID NO: 369 - protein, 22 aa, Artificial Sequence
  Description of Artificial Sequence: Synthetic peptide
ARDDTARRVRGVPYYYYYAMDV

SEQ ID NO: 370 - protein, 459 aa, Artificial Sequence
  Description of Artificial Sequence: Synthetic polypeptide
QVQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 108 aa, Artificial Sequence
  Description of Artificial Sequence: Synthetic polypeptide
ETTLTQSPAFMSATPGDEVNISCKASQDIDDDVSWYQQKPGGAPIFLIQEASTLVPGIPPRFSGSGFGTDFTLTIKNMESEDAAYYFCLQHDNLPLTFGGGTKVDIKR

SEQ ID NO: 372 - protein, 6 aa, Artificial Sequence
  Description of Artificial Sequence: Synthetic peptide
QDIDDD

SEQ ID NO: 373 - protein, 3 aa, Artificial Sequence
  Description of Artificial Sequence: Synthetic peptide
EAS

SEQ ID NO: 374 - protein, 9 aa, Artificial Sequence
  Description of Artificial Sequence: Synthetic peptide
LQHDNLPLT

SEQ ID NO: 375 - protein, 214 aa, Artificial Sequence
  Description of Artificial Sequence: Synthetic polypeptide
ETTLTQSPAFMSATPGDEVNISCKASQDIDDDVSWYQQKPGGAPIFLIQEASTLVPGIPPRFSGSGFGTDFTLTIKNMESEDAAYYFCLQHDNLPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - protein, 126 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEDPGPVAGPYYYYGMDVWGQGTTVTVSS

SEQ ID NO: 377 - protein, 8 aa, Artificial Sequence
  Description of Artificial Sequence: Synthetic peptide
GYTLTELS

SEQ ID NO: 378 - protein, 8 aa, Artificial Sequence
  Description of Artificial Sequence: Synthetic peptide
FDPEDGET

SEQ ID NO: 379 - protein, 19 aa, Artificial Sequence
  Description of Artificial Sequence: Synthetic peptide
ATEDPGPVAGPYYYYGMDV

SEQ ID NO: 380 - protein, 456 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEDPGPVAGPYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 381 - protein, 113 aa, Artificial Sequence
  Description of Artificial Sequence: Synthetic polypeptide
DVVMTQSPLVLPVTPGEPASISCRSSQSLLYINGYHYLDWYVQRPGQSPQLLIFLGSTRASGVPDRFSGSGSGTDFTLEISKVEAEDVGIYFCMQALQTPPTFGGGTKVEIKR

SEQ ID NO: 382 - protein, 11 aa, Artificial Sequence
  Description of Artificial Sequence: Synthetic peptide
QSLLYINGYHY

SEQ ID NO: 383 - protein, 3 aa, Artificial Sequence
  Description of Artificial Sequence: Synthetic peptide
LGS

SEQ ID NO: 384 - protein, 9 aa, Artificial Sequence
  Description of Artificial Sequence: Synthetic peptide
MQALQTPPT

SEQ ID NO: 385 - protein, 219 aa, Artificial Sequence
  Description of Artificial Sequence: Synthetic polypeptide
DVVMTQSPLVLPVTPGEPASISCRSSQSLLYINGYHYLDWYVQRPGQSPQLLIFLGSTRASGVPDRFSGSGSGTDFTLEISKVEAEDVGIYFCMQALQTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 129 aa, Artificial Sequence; identical to SEQ ID NO: 366
  Description of Artificial Sequence: Synthetic polypeptide

SEQ ID NO: 387 - protein, 8 aa, Artificial Sequence
  Description of Artificial Sequence: Synthetic peptide
GGTFSSSA

SEQ ID NO: 388 - protein, 8 aa, Artificial Sequence
  Description of Artificial Sequence: Synthetic peptide
IIPIYGIT

SEQ ID NO: 389 - protein, 22 aa, Artificial Sequence
  Description of Artificial Sequence: Synthetic peptide
ARDDTARRVRGVPYYYYYAMDV

SEQ ID NO: 390 - protein, 459 aa, Artificial Sequence; identical to SEQ ID NO: 370
  Description of Artificial Sequence: Synthetic polypeptide

SEQ ID NO: 391 - protein, 114 aa, Artificial Sequence
  Description of Artificial Sequence: Synthetic polypeptide
DIVMTQTPLSLPVTPGEPASISCRPSQSLLDSDDGNTYLDWYLQKPGQSPQLLIHTLSYRASGVPDRFSGSGSGTDFTLKISRVEAEDVGVYYCMQRLQFPLTFGGGTKVEIKR

SEQ ID NO: 392 - protein, 12 aa, Artificial Sequence
  Description of Artificial Sequence: Synthetic peptide
QSLLDSDDGNTY

SEQ ID NO: 393 - protein, 3 aa, Artificial Sequence
  Description of Artificial Sequence: Synthetic peptide
TLS

SEQ ID NO: 394 - protein, 9 aa, Artificial Sequence
  Description of Artificial Sequence: Synthetic peptide
MQRLQFPLT

SEQ ID NO: 395 - protein, 220 aa, Artificial Sequence
  Description of Artificial Sequence: Synthetic polypeptide
DIVMTQTPLSLPVTPGEPASISCRPSQSLLDSDDGNTYLDWYLQKPGQSPQLLIHTLSYRASGVPDRFSGSGSGTDFTLKISRVEAEDVGVYYCMQRLQFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 396 - protein, 126 aa, Artificial Sequence; identical to SEQ ID NO: 336
  Description of Artificial Sequence: Synthetic polypeptide

SEQ ID NO: 397 - protein, 8 aa, Artificial Sequence
  Description of Artificial Sequence: Synthetic peptide
GYTLTELS

SEQ ID NO: 398 - protein, 8 aa, Artificial Sequence
  Description of Artificial Sequence: Synthetic peptide
FDPEDGET

SEQ ID NO: 399 - protein, 19 aa, Artificial Sequence
  Description of Artificial Sequence: Synthetic peptide
ATGVPAAIGVYYYYYYMDV

SEQ ID NO: 400 - protein, 456 aa, Artificial Sequence; identical to SEQ ID NO: 340
  Description of Artificial Sequence: Synthetic polypeptide

SEQ ID NO: 401 - protein, 113 aa, Artificial Sequence
  Description of Artificial Sequence: Synthetic polypeptide
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVDIKR

SEQ ID NO: 402 - protein, 11 aa, Artificial Sequence
  Description of Artificial Sequence: Synthetic peptide
QSLLYRNGYNY

SEQ ID NO: 403 - protein, 3 aa, Artificial Sequence
  Description of Artificial Sequence: Synthetic peptide
WGS

SEQ ID NO: 404 - protein, 9 aa, Artificial Sequence
  Description of Artificial Sequence: Synthetic peptide
MQAVQNPPT

SEQ ID NO: 405 - protein, 219 aa, Artificial Sequence
  Description of Artificial Sequence: Synthetic polypeptide
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 129 aa, Artificial Sequence; identical to SEQ ID NO: 366
  Description of Artificial Sequence: Synthetic polypeptide

SEQ ID NO: 407 - protein, 8 aa, Artificial Sequence
  Description of Artificial Sequence: Synthetic peptide
GGTFSSSA

SEQ ID NO: 408 - protein, 8 aa, Artificial Sequence
  Description of Artificial Sequence: Synthetic peptide
IIPIYGIT

SEQ ID NO: 409 - protein, 22 aa, Artificial Sequence
  Description of Artificial Sequence: Synthetic peptide
ARDDTARRVRGVPYYYYYAMDV

SEQ ID NO: 410 - protein, 459 aa, Artificial Sequence; identical to SEQ ID NO: 370
  Description of Artificial Sequence: Synthetic polypeptide

SEQ ID NO: 411 - protein, 109 aa, Artificial Sequence
  Description of Artificial Sequence: Synthetic polypeptide
DVVMTQSPAFLSVTPGERVTLSCKASQTMNNYLAWYQQKPGQAPRLLIYDASTRATDTPPRFSGSGSGTEFTLTISSVQSEDFALYYCQQYGDWLPITFGQGTRLEIKR

SEQ ID NO: 412 - protein, 6 aa, Artificial Sequence
  Description of Artificial Sequence: Synthetic peptide
QTMNNY

SEQ ID NO: 413 - protein, 3 aa, Artificial Sequence
  Description of Artificial Sequence: Synthetic peptide
DAS

SEQ ID NO: 414 - protein, 10 aa, Artificial Sequence
  Description of Artificial Sequence: Synthetic peptide
QQYGDWLPIT

SEQ ID NO: 415 - protein, 215 aa, Artificial Sequence
  Description of Artificial Sequence: Synthetic polypeptide
DVVMTQSPAFLSVTPGERVTLSCKASQTMNNYLAWYQQKPGQAPRLLIYDASTRATDTPPRFSGSGSGTEFTLTISSVQSEDFALYYCQQYGDWLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 124 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAFPEATISYYYYMDVWGKGTTVTVSS

SEQ ID NO: 417 - protein, 8 aa, Artificial Sequence
  Description of Artificial Sequence: Synthetic peptide
GYTLTELS

SEQ ID NO: 418 - protein, 8 aa, Artificial Sequence
  Description of Artificial Sequence: Synthetic peptide
FDPEDGET

SEQ ID NO: 419 - protein, 17 aa, Artificial Sequence
  Description of Artificial Sequence: Synthetic peptide
ATAFPEATISYYYYMDV

SEQ ID NO: 420 - protein, 454 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAFPEATISYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 113 aa, Artificial Sequence
  Description of Artificial Sequence: Synthetic polypeptide
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVEIKR

SEQ ID NO: 422 - protein, 11 aa, Artificial Sequence
  Description of Artificial Sequence: Synthetic peptide
QSLLYRNGYNY

SEQ ID NO: 423 - protein, 3 aa, Artificial Sequence
  Description of Artificial Sequence: Synthetic peptide
WGS

SEQ ID NO: 424 - protein, 9 aa, Artificial Sequence
  Description of Artificial Sequence: Synthetic peptide
MQAVQNPPT

SEQ ID NO: 425 - protein, 219 aa, Artificial Sequence
  Description of Artificial Sequence: Synthetic polypeptide
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 426 - protein, 129 aa, Artificial Sequence
  Description of Artificial Sequence: Synthetic polypeptide
QMQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSS

SEQ ID NO: 427 - protein, 8 aa, Artificial Sequence
  Description of Artificial Sequence: Synthetic peptide
GGTFSSSA

SEQ ID NO: 428 - protein, 8 aa, Artificial Sequence
  Description of Artificial Sequence: Synthetic peptide
IIPIYGIT

SEQ ID NO: 429 - protein, 22 aa, Artificial Sequence
  Description of Artificial Sequence: Synthetic peptide
ARDDTARRVRGVPYYYYYAMDV

SEQ ID NO: 430 - protein, 459 aa, Artificial Sequence
  Description of Artificial Sequence: Synthetic polypeptide
QMQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 114 aa, Artificial Sequence
  Description of Artificial Sequence: Synthetic polypeptide
DIVMTQTPLSLPVTPGEPASMSCRSSRSLLDSDDGNTHLDWYLQKPGQSPQLLIQSLSYRASGVPDRFSGSGSGTDFTLEISRVEAEDVGIYYCMQRKEFPLTFGGGTKVEIKR

SEQ ID NO: 432 - protein, 12 aa, Artificial Sequence
  Description of Artificial Sequence: Synthetic peptide
RSLLDSDDGNTH

SEQ ID NO: 433 - protein, 3 aa, Artificial Sequence
  Description of Artificial Sequence: Synthetic peptide
SLS

SEQ ID NO: 434 - protein, 9 aa, Artificial Sequence
  Description of Artificial Sequence: Synthetic peptide
MQRKEFPLT

SEQ ID NO: 435 - protein, 220 aa, Artificial Sequence
  Description of Artificial Sequence: Synthetic polypeptide
DIVMTQTPLSLPVTPGEPASMSCRSSRSLLDSDDGNTHLDWYLQKPGQSPQLLIQSLSYRASGVPDRFSGSGSGTDFTLEISRVEAEDVGIYYCMQRKEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 436 - protein, 128 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGPWYYDSSGYSSYAYYMDVWGQGTTVTVSS

SEQ ID NO: 437 - protein, 8 aa, Artificial Sequence
  Description of Artificial Sequence: Synthetic peptide
GGTFSSYA

SEQ ID NO: 438 - protein, 8 aa, Artificial Sequence
  Description of Artificial Sequence: Synthetic peptide
IIPIFGTA

SEQ ID NO: 439 - protein, 21 aa, Artificial Sequence
  Description of Artificial Sequence: Synthetic peptide
ARGPWYYDSSGYSSYAYYMDV

SEQ ID NO: 440 - protein, 458 aa, Artificial Sequence; identical to SEQ ID NO: 190
  Description of Artificial Sequence: Synthetic polypeptide

SEQ ID NO: 441 - protein, 114 aa, Artificial Sequence
  Description of Artificial Sequence: Synthetic polypeptide
DVVMTQSPLSLPVTPGEPASISCRSSQSLLHSDGYNYLDWYLQKPGQSPQLLIYLGSNRASGVPDRFSGSGSGTDFTLKISRVEAEDVGVYYCMQALHTPGVTFGGGTKVEIKR

SEQ ID NO: 442 - protein, 11 aa, Artificial Sequence
  Description of Artificial Sequence: Synthetic peptide
QSLLHSDGYNY

SEQ ID NO: 443 - protein, 3 aa, Artificial Sequence
  Description of Artificial Sequence: Synthetic peptide
LGS

SEQ ID NO: 444 - protein, 10 aa, Artificial Sequence
  Description of Artificial Sequence: Synthetic peptide
MQALHTPGVT

SEQ ID NO: 445 - protein, 220 aa, Artificial Sequence
  Description of Artificial Sequence: Synthetic polypeptide
DVVMTQSPLSLPVTPGEPASISCRSSQSLLHSDGYNYLDWYLQKPGQSPQLLIYLGSNRASGVPDRFSGSGSGTDFTLKISRVEAEDVGVYYCMQALHTPGVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 123 aa, Artificial Sequence
  Description of Artificial Sequence: Synthetic polypeptide
QLQLQESGPGLVKPSETLSLTCTVTGGSISSSSYYWAWIRQPPGKGLEWIGGIYYSGSTYYNVSLESRVTISQDTSKNQFSLKLTSVTAADTAVYYCARGAWELRLGDWFDPWGQGTLVTVSS

SEQ ID NO: 447 - protein, 10 aa, Artificial Sequence
  Description of Artificial Sequence: Synthetic peptide
GGSISSSSYY

SEQ ID NO: 448 - protein, 7 aa, Artificial Sequence
  Description of Artificial Sequence: Synthetic peptide
IYYSGST

SEQ ID NO: 449 - protein, 15 aa, Artificial Sequence
  Description of Artificial Sequence: Synthetic peptide
ARGAWELRLGDWFDP

SEQ ID NO: 450 - protein, 453 aa, Artificial Sequence
  Description of Artificial Sequence: Synthetic polypeptide
QLQLQESGPGLVKPSETLSLTCTVTGGSISSSSYYWAWIRQPPGKGLEWIGGIYYSGSTYYNVSLESRVTISQDTSKNQFSLKLTSVTAADTAVYYCARGAWELRLGDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 451 - protein, 118 aa, Artificial Sequence
  Description of Artificial Sequence: Synthetic polypeptide
QSVLTQPPSVSGAPGQRVTISCTGSSSNIGAGYDIQWYQQLPGTAPKLLIYGYSNRPSGVPDRFSGSKSGTSASLAITGLQAEDEADYYCQSYDSSLSVYVVFGGGTQLTVLGQPKAA

SEQ ID NO: 452 - protein, 9 aa, Artificial Sequence
  Description of Artificial Sequence: Synthetic peptide
SSNIGAGYD

SEQ ID NO: 453 - protein, 3 aa, Artificial Sequence
  Description of Artificial Sequence: Synthetic peptide
GYS

SEQ ID NO: 454 - protein, 12 aa, Artificial Sequence
  Description of Artificial Sequence: Synthetic peptide
QSYDSSLSVYVV

SEQ ID NO: 455 - protein, 218 aa, Artificial Sequence
  Description of Artificial Sequence: Synthetic polypeptide
QSVLTQPPSVSGAPGQRVTISCTGSSSNIGAGYDIQWYQQLPGTAPKLLIYGYSNRPSGVPDRFSGSKSGTSASLAITGLQAEDEADYYCQSYDSSLSVYVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 456 - protein, 122 aa, Artificial Sequence
  Description of Artificial Sequence: Synthetic polypeptide
QVQLQESGGGVVQPGGSLRLSCAASRFTFEDYAMHWVRQPPGKGLEWVSGISWKSGGINYADSVKGRFTISRDNAQNSLYLQMNSLRAEDTALYYCVKDPTLVATDRAFNIWGQGTMVTVSS

SEQ ID NO: 457 - protein, 8 aa, Artificial Sequence
  Description of Artificial Sequence: Synthetic peptide
RFTFEDYA

SEQ ID NO: 458 - protein, 8 aa, Artificial Sequence
  Description of Artificial Sequence: Synthetic peptide
ISWKSGGI

SEQ ID NO: 459 - protein, 15 aa, Artificial Sequence
  Description of Artificial Sequence: Synthetic peptide
VKDPTLVATDRAFNI

SEQ ID NO: 460 - protein, 452 aa, Artificial Sequence
  Description of Artificial Sequence: Synthetic polypeptide
QVQLQESGGGVVQPGGSLRLSCAASRFTFEDYAMHWVRQPPGKGLEWVSGISWKSGGINYADSVKGRFTISRDNAQNSLYLQMNSLRAEDTALYYCVKDPTLVATDRAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 461 - protein, 117 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQYLQTPDTFGQGTKLEIKRAAPS

SEQ ID NO: 462 - protein, 11 aa, Artificial Sequence
  Description of Artificial Sequence: Synthetic peptide
QSLLHSNGYNY

SEQ ID NO: 463 - protein, 3 aa, Artificial Sequence
  Description of Artificial Sequence: Synthetic peptide
LGS

SEQ ID NO: 464 - protein, 9 aa, Artificial Sequence
  Description of Artificial Sequence: Synthetic peptide
MQYLQTPDT

SEQ ID NO: 465 - protein, 219 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQYLQTPDTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 466 - protein, 129 aa, Artificial Sequence; identical to SEQ ID NO: 366
  Description of Artificial Sequence: Synthetic polypeptide

SEQ ID NO: 467 - protein, 8 aa, Artificial Sequence
  Description of Artificial Sequence: Synthetic peptide
GGTFSSSA

SEQ ID NO: 468 - protein, 8 aa, Artificial Sequence
  Description of Artificial Sequence: Synthetic peptide
IIPIYGIT

SEQ ID NO: 469 - protein, 22 aa, Artificial Sequence
  Description of Artificial Sequence: Synthetic peptide
ARDDTARRVRGVPYYYYYAMDV

SEQ ID NO: 470 - protein, 459 aa, Artificial Sequence; identical to SEQ ID NO: 370
  Description of Artificial Sequence: Synthetic polypeptide

SEQ ID NO: 471 - protein, 114 aa, Artificial Sequence
  Description of Artificial Sequence: Synthetic polypeptide
EIVLTQSPDFQSVTPKEKVTITCRASQNIDSSLHWYQQKPGQSPKLLINYASQSFSGVPSRFSGSGSGTDFTLTIDSLEPEDAATYFCHQSSSLPLTFGGGTKVEIRRTVAAPS

SEQ ID NO: 472 - protein, 6 aa, Artificial Sequence
  Description of Artificial Sequence: Synthetic peptide
QNIDSS

SEQ ID NO: 473 - protein, 3 aa, Artificial Sequence
  Description of Artificial Sequence: Synthetic peptide
YAS

SEQ ID NO: 474 - protein, 9 aa, Artificial Sequence
  Description of Artificial Sequence: Synthetic peptide
HQSSSLPLT

SEQ ID NO: 475 - protein, 218 aa, Artificial Sequence; identical to SEQ ID NO: 455
  Description of Artificial Sequence: Synthetic polypeptide

SEQ ID NO: 476 - protein, 129 aa, Artificial Sequence
  Description of Artificial Sequence: Synthetic polypeptide
EVQLVQSGAEVKKPGSSVKVSCKTSGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSS

SEQ ID NO: 477 - protein, 8 aa, Artificial Sequence
  Description of Artificial Sequence: Synthetic peptide
GGTFSSSA

SEQ ID NO: 478 - protein, 8 aa, Artificial Sequence
  Description of Artificial Sequence: Synthetic peptide
IIPIYGIT

SEQ ID NO: 479 - protein, 22 aa, Artificial Sequence
  Description of Artificial Sequence: Synthetic peptide
ARDDTARRVRGVPYYYYYAMDV

SEQ ID NO: 480 - protein, 459 aa, Artificial Sequence
  Description of Artificial Sequence: Synthetic polypeptide
EVQLVQSGAEVKKPGSSVKVSCKTSGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 114 aa, Artificial Sequence
  Description of Artificial Sequence: Synthetic polypeptide
EIVLTQSPGTLSLSPGERATLSCRASQSVSSYLAWYQQKPGQAPRLLIYDASNRATGIPARFSGSGSGTDFTLTISSLQSEDFAVYYCQQYDDWPQTFGQGTRLEIKRTVAAPS

SEQ ID NO: 482 - protein, 6 aa, Artificial Sequence
  Description of Artificial Sequence: Synthetic peptide
QSVSSY

SEQ ID NO: 483 - protein, 3 aa, Artificial Sequence
  Description of Artificial Sequence: Synthetic peptide
DAS

SEQ ID NO: 484 - protein, 9 aa, Artificial Sequence
  Description of Artificial Sequence: Synthetic peptide
QQYDDWPQT

SEQ ID NO: 485 - protein, 214 aa, Artificial Sequence
  Description of Artificial Sequence: Synthetic polypeptide
EIVLTQSPGTLSLSPGERATLSCRASQSVSSYLAWYQQKPGQAPRLLIYDASNRATGIPARFSGSGSGTDFTLTISSLQSEDFAVYYCQQYDDWPQTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 486 - protein, 129 aa, Artificial Sequence; identical to SEQ ID NO: 426
  Description of Artificial Sequence: Synthetic polypeptide

SEQ ID NO: 487 - protein, 8 aa, Artificial Sequence
  Description of Artificial Sequence: Synthetic peptide
GGTFSSSA

SEQ ID NO: 488 - protein, 8 aa, Artificial Sequence
  Description of Artificial Sequence: Synthetic peptide
IIPIYGIT

SEQ ID NO: 489 - protein, 22 aa, Artificial Sequence
  Description of Artificial Sequence: Synthetic peptide
ARDDTARRVRGVPYYYYYAMDV

SEQ ID NO: 490 - protein, 459 aa, Artificial Sequence; identical to SEQ ID NO: 430
  Description of Artificial Sequence: Synthetic polypeptide

SEQ ID NO: 491 - protein, 114 aa, Artificial Sequence
  Description of Artificial Sequence: Synthetic polypeptide
EIVMTQSPATLSLSTGERATLFCRTSQNVYGEVAWYQQKPGQAPRLLIYDTFERAAGIPAKFSGSGSGTDFTLTISRVEPEDFAVYYCQQRRDWPITFGQGTRLEIKRTVAAPS

SEQ ID NO: 492 - protein, 6 aa, Artificial Sequence
  Description of Artificial Sequence: Synthetic peptide
QNVYGE

SEQ ID NO: 493 - protein, 3 aa, Artificial Sequence
  Description of Artificial Sequence: Synthetic peptide
DTF

SEQ ID NO: 494 - protein, 9 aa, Artificial Sequence
  Description of Artificial Sequence: Synthetic peptide
QQRRDWPIT

SEQ ID NO: 495 - protein, 214 aa, Artificial Sequence
  Description of Artificial Sequence: Synthetic polypeptide
EIVMTQSPATLSLSTGERATLFCRTSQNVYGEVAWYQQKPGQAPRLLIYDTFERAAGIPAKFSGSGSGTDFTLTISRVEPEDFAVYYCQQRRDWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 496 - protein, 129 aa, Artificial Sequence; identical to SEQ ID NO: 366
  Description of Artificial Sequence: Synthetic polypeptide

SEQ ID NO: 497 - protein, 8 aa, Artificial Sequence
  Description of Artificial Sequence: Synthetic peptide
GGTFSSSA

SEQ ID NO: 498 - protein, 8 aa, Artificial Sequence
  Description of Artificial Sequence: Synthetic peptide
IIPIYGIT

SEQ ID NO: 499 - protein, 22 aa, Artificial Sequence
  Description of Artificial Sequence: Synthetic peptide
ARDDTARRVRGVPYYYYYAMDV

SEQ ID NO: 500 - protein, 459 aa, Artificial Sequence; identical to SEQ ID NO: 370
  Description of Artificial Sequence: Synthetic polypeptide

SEQ ID NO: 501 - protein, 114 aa, Artificial Sequence
  Description of Artificial Sequence: Synthetic polypeptide
DIQMTQSPSSLSASVGDRVTITCQASRDISDSLSWYQQKPGKAPKLLIFDASNLKTGVSSRFSGSGSGTDFTFTISSLQPEDIATYYCHQYDNLPLTFGGGTKVEIKRTVAAPS

SEQ ID NO: 502 - protein, 6 aa, Artificial Sequence
  Description of Artificial Sequence: Synthetic peptide
RDISDS

SEQ ID NO: 503 - protein, 3 aa, Artificial Sequence
  Description of Artificial Sequence: Synthetic peptide
DAS

SEQ ID NO: 504 - protein, 9 aa, Artificial Sequence
  Description of Artificial Sequence: Synthetic peptide
HQYDNLPLT

SEQ ID NO: 505 - protein, 214 aa, Artificial Sequence
  Description of Artificial Sequence: Synthetic polypeptide
DIQMTQSPSSLSASVGDRVTITCQASRDISDSLSWYQQKPGKAPKLLIFDASNLKTGVSSRFSGSGSGTDFTFTISSLQPEDIATYYCHQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 506 - protein, 129 aa, Artificial Sequence; identical to SEQ ID NO: 426
  Description of Artificial Sequence: Synthetic polypeptide

SEQ ID NO: 507 - protein, 8 aa, Artificial Sequence
  Description of Artificial Sequence: Synthetic peptide
GGTFSSSA

SEQ ID NO: 508 - protein, 8 aa, Artificial Sequence
  Description of Artificial Sequence: Synthetic peptide
IIPIYGIT

SEQ ID NO: 509 - protein, 22 aa, Artificial Sequence
  Description of Artificial Sequence: Synthetic peptide
ARDDTARRVRGVPYYYYYAMDV

SEQ ID NO: 510 - protein, 459 aa, Artificial Sequence; identical to SEQ ID NO: 430
  Description of Artificial Sequence: Synthetic polypeptide

SEQ ID NO: 511 - protein, 114 aa, Artificial Sequence
  Description of Artificial Sequence: Synthetic polypeptide
EIVMTQSPATLSLSPGERATLSCRASESVTTFLAWYQQKPGQAPRLLITDASNRATGIPGRFSGSGSGTDFTLTISSLEPEDFAVYYCHQHTNWPLTFGGGTKLEIKRTVAAPS

SEQ ID NO: 512 - protein, 6 aa, Artificial Sequence
  Description of Artificial Sequence: Synthetic peptide
ESVTTF

SEQ ID NO: 513 - protein, 3 aa, Artificial Sequence
  Description of Artificial Sequence: Synthetic peptide
DAS

SEQ ID NO: 514 - protein, 9 aa, Artificial Sequence
  Description of Artificial Sequence: Synthetic peptide
HQHTNWPLT

SEQ ID NO: 515 - protein, 214 aa, Artificial Sequence
  Description of Artificial Sequence: Synthetic polypeptide
EIVMTQSPATLSLSPGERATLSCRASESVTTFLAWYQQKPGQAPRLLITDASNRATGIPGRFSGSGSGTDFTLTISSLEPEDFAVYYCHQHTNWPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 516 - protein, 129 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVGYCSGGSCYISYYYGMDVWGQGTTVTVSS

SEQ ID NO: 517 - protein, 8 aa, Artificial Sequence
  Description of Artificial Sequence: Synthetic peptide
GYTLTELS

SEQ ID NO: 518 - protein, 8 aa, Artificial Sequence
  Description of Artificial Sequence: Synthetic peptide
FDPEDGET

SEQ ID NO: 519 - protein, 22 aa, Artificial Sequence
  Description of Artificial Sequence: Synthetic peptide
ATEVGYCSGGSCYISYYYGMDV

SEQ ID NO: 520 - protein, 459 aa, Artificial Sequence
  Description of Artificial Sequence: Synthetic polypeptide
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVGYCSGGSCYISYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 521 - protein, 119 aa, Artificial Sequence
  Description of Artificial Sequence: Synthetic polypeptide
DVVMTQSPLSLPVTPGEPASISCRSSQSLLYRNGHNFLDWYVQKPGQSPQLLIYLGSNRASGVPDRFSGSGSGTDFTLKISRVEAEDVGVYYCMQALQTPPTFGQGTKLEIKRTVAAPS

SEQ ID NO: 522 - protein, 11 aa, Artificial Sequence
  Description of Artificial Sequence: Synthetic peptide
QSLLYRNGHNF

SEQ ID NO: 523 - protein, 3 aa, Artificial Sequence
  Description of Artificial Sequence: Synthetic peptide
LGS

SEQ ID NO: 524 - protein, 9 aa, Artificial Sequence
  Description of Artificial Sequence: Synthetic peptide
MQALQTPPT

SEQ ID NO: 525 - protein, 219 aa, Artificial Sequence
  Description of Artificial Sequence: Synthetic polypeptide
DVVMTQSPLSLPVTPGEPASISCRSSQSLLYRNGHNFLDWYVQKPGQSPQLLIYLGSNRASGVPDRFSGSGSGTDFTLKISRVEAEDVGVYYCMQALQTPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 526 - protein, 8 aa, Artificial Sequence
  Description of Artificial Sequence: Synthetic peptide
GGTFSSYA

SEQ ID NO: 527 - protein, 8 aa, Artificial Sequence
  Description of Artificial Sequence: Synthetic peptide
IIPIFGTA

SEQ ID NO: 528 - protein, 13 aa, Artificial Sequence
  Description of Artificial Sequence: Synthetic peptide
AREEVSSPYGMDV

SEQ ID NO: 529 - protein, 9 aa, Artificial Sequence
  Description of Artificial Sequence: Synthetic peptide
TGAVTSGHY

SEQ ID NO: 530 - protein, 3 aa, Artificial Sequence
  Description of Artificial Sequence: Synthetic peptide
DTG

SEQ ID NO: 531 - protein, 10 aa, Artificial Sequence
  Description of Artificial Sequence: Synthetic peptide
LLSYSGASWV

SEQ ID NO: 532 - protein, 8 aa, Artificial Sequence
  Description of Artificial Sequence: Synthetic peptide
GGTFSSSA

SEQ ID NO: 533 - protein, 8 aa, Artificial Sequence
  Description of Artificial Sequence: Synthetic peptide
IIPIYGIT

SEQ ID NO: 534 - protein, 22 aa, Artificial Sequence
  Description of Artificial Sequence: Synthetic peptide
ARDDTARRVRGVPYYYYYAMDV

SEQ ID NO: 535 - protein, 6 aa, Artificial Sequence
  Description of Artificial Sequence: Synthetic peptide
QGIGNY

SEQ ID NO: 536 - protein, 3 aa, Artificial Sequence
  Description of Artificial Sequence: Synthetic peptide
SAS

SEQ ID NO: 537 - protein, 9 aa, Artificial Sequence
  Description of Artificial Sequence: Synthetic peptide
QQLKDYPIT

SEQ ID NO: 538 - protein, 8 aa, Artificial Sequence
  Description of Artificial Sequence: Synthetic peptide
GFSLSHFS

SEQ ID NO: 539 - protein, 8 aa, Artificial Sequence
  Description of Artificial Sequence: Synthetic peptide
FDPEEGGT

SEQ ID NO: 540 - protein, 14 aa, Artificial Sequence
  Description of Artificial Sequence: Synthetic peptide
ATGIWYSSGWPVDY

SEQ ID NO: 541 - protein, 11 aa, Artificial Sequence
  Description of Artificial Sequence: Synthetic peptide
QSLLDSSGYNY

SEQ ID NO: 542 - protein, 3 aa, Artificial Sequence
  Description of Artificial Sequence: Synthetic peptide
LGS

SEQ ID NO: 543 - protein, 9 aa, Artificial Sequence
  Description of Artificial Sequence: Synthetic peptide
MQALQTPIT

SEQ ID NO: 544 - protein, 8 aa, Artificial Sequence
  Description of Artificial Sequence: Synthetic peptide
GYTLTELS

SEQ ID NO: 545 - protein, 8 aa, Artificial Sequence
  Description of Artificial Sequence: Synthetic peptide
FDPEDGET

SEQ ID NO: 546 - protein, 18 aa, Artificial Sequence
  Description of Artificial Sequence: Synthetic peptide
ATVSRVRGVINYYYYMDV

SEQ ID NO: 547 - protein, 11 aa, Artificial Sequence
  Description of Artificial Sequence: Synthetic peptide
QSLLYRNGNNY

SEQ ID NO: 548 - protein, 3 aa, Artificial Sequence
  Description of Artificial Sequence: Synthetic peptide
LGS

SEQ ID NO: 549 - protein, 9 aa, Artificial Sequence
  Description of Artificial Sequence: Synthetic peptide
MQALQTPPT

SEQ ID NO: 550 - protein, 8 aa, Artificial Sequence
  Description of Artificial Sequence: Synthetic peptide
GGTFSSSA

SEQ ID NO: 551 - protein, 8 aa, Artificial Sequence
  Description of Artificial Sequence: Synthetic peptide
IIPIYGIT

SEQ ID NO: 552 - protein, 22 aa, Artificial Sequence
  Description of Artificial Sequence: Synthetic peptide
ARDDTARRVRGVPYYYYYAMDV

SEQ ID NO: 553 - protein, 6 aa, Artificial Sequence
  Description of Artificial Sequence: Synthetic peptide
QSVDSS

SEQ ID NO: 554 - protein, 3 aa, Artificial Sequence
  Description of Artificial Sequence: Synthetic peptide
DAS

SEQ ID NO: 555 - protein, 9 aa, Artificial Sequence
  Description of Artificial Sequence: Synthetic peptide
QQYKDWPFT

SEQ ID NO: 556 - protein, 8 aa, Artificial Sequence
  Description of Artificial Sequence: Synthetic peptide
GGTFGTYA

SEQ ID NO: 557 - protein, 8 aa, Artificial Sequence
  Description of Artificial Sequence: Synthetic peptide
ITPISATI

SEQ ID NO: 558 - protein, 13 aa, Artificial Sequence
  Description of Artificial Sequence: Synthetic peptide
ARGFEYSDGLLDD

SEQ ID NO: 559 - protein, 12 aa, Artificial Sequence
  Description of Artificial Sequence: Synthetic peptide
QSLFYSDDGNTY

SEQ ID NO: 560 - protein, 3 aa, Artificial Sequence
  Description of Artificial Sequence: Synthetic peptide
RLS

SEQ ID NO: 561 - protein, 9 aa, Artificial Sequence
  Description of Artificial Sequence: Synthetic peptide
MQHMEFPLT

SEQ ID NO: 562 - protein, 10 aa, Artificial Sequence
  Description of Artificial Sequence: Synthetic peptide
GGSISSSSYY

SEQ ID NO: 563 - protein, 7 aa, Artificial Sequence
  Description of Artificial Sequence: Synthetic peptide
IYYSGST

SEQ ID NO: 564 - protein, 15 aa, Artificial Sequence
  Description of Artificial Sequence: Synthetic peptide
ARGAWELRLGDWFDP

SEQ ID NO: 565 - protein, 9 aa, Artificial Sequence
  Description of Artificial Sequence: Synthetic peptide
SSNIGAGYD

SEQ ID NO: 566 - protein, 3 aa, Artificial Sequence
  Description of Artificial Sequence: Synthetic peptide
GNN

SEQ ID NO: 567 - protein, 12 aa, Artificial Sequence
  Description of Artificial Sequence: Synthetic peptide
QSYDSSLSIYVV

SEQ ID NO: 568 - protein, 9 aa, Artificial Sequence
  Description of Artificial Sequence: Synthetic peptide
SGSISSTNW

SEQ ID NO: 569 - protein, 7 aa, Artificial Sequence
  Description of Artificial Sequence: Synthetic peptide
IYHSGST

SEQ ID NO: 570 - protein, 10 aa, Artificial Sequence
  Description of Artificial Sequence: Synthetic peptide
ARVGPAAIYY

SEQ ID NO: 571 - protein, 8 aa, Artificial Sequence
  Description of Artificial Sequence: Synthetic peptide
SNNVGYEG

SEQ ID NO: 572 - protein, 3 aa, Artificial Sequence
  Description of Artificial Sequence: Synthetic peptide
RNN

SEQ ID NO: 573 - protein, 11 aa, Artificial Sequence
  Description of Artificial Sequence: Synthetic peptide
SAWDSSLNAVV

SEQ ID NO: 574 - protein, 8 aa, Artificial Sequence
  Description of Artificial Sequence: Synthetic peptide
GYTLTELS

SEQ ID NO: 575 - protein, 8 aa, Artificial Sequence
  Description of Artificial Sequence: Synthetic peptide
FDPEDGET

SEQ ID NO: 576 - protein, 21 aa, Artificial Sequence
  Description of Artificial Sequence: Synthetic peptide
ATAKPGIAVAGQNYYYYYMDV

SEQ ID NO: 577 - protein, 11 aa, Artificial Sequence
  Description of Artificial Sequence: Synthetic peptide
QSLLYRNGNNY

SEQ ID NO: 578 - protein, 3 aa, Artificial Sequence
  Description of Artificial Sequence: Synthetic peptide
LGS

SEQ ID NO: 579 - protein, 9 aa, Artificial Sequence
  Description of Artificial Sequence: Synthetic peptide
MQALQTPPT

SEQ ID NO: 580 - protein, 8 aa, Artificial Sequence
  Description of Artificial Sequence: Synthetic peptide
GFTFSSYA

SEQ ID NO: 581 - protein, 8 aa, Artificial Sequence
  Description of Artificial Sequence: Synthetic peptide
ISYDGSNK

SEQ ID NO: 582 - protein, 17 aa, Artificial Sequence
  Description of Artificial Sequence: Synthetic peptide
ASSPIGYSYGYWGGMDV

SEQ ID NO: 583 - protein, 9 aa, Artificial Sequence
  Description of Artificial Sequence: Synthetic peptide
SGIDVRTNK

SEQ ID NO: 584 - protein, 7 aa, Artificial Sequence
  Description of Artificial Sequence: Synthetic peptide
FQSDSDK

SEQ ID NO: 585 - protein, 9 aa, Artificial Sequence
  Description of Artificial Sequence: Synthetic peptide
LIWHTSGWV

SEQ ID NO: 586 - protein, 8 aa, Artificial Sequence
  Description of Artificial Sequence: Synthetic peptide
GYTLTELS

SEQ ID NO: 587 - protein, 8 aa, Artificial Sequence
  Description of Artificial Sequence: Synthetic peptide
FDPEDGET

SEQ ID NO: 588 - protein, 17 aa, Artificial Sequence
  Description of Artificial Sequence: Synthetic peptide
ATGPAAAGVGYYYYMDV

SEQ ID NO: 589 - protein, 11 aa, Artificial Sequence
  Description of Artificial Sequence: Synthetic peptide
QSLLYRNGYNY

SEQ ID NO: 590 - protein, 3 aa, Artificial Sequence
  Description of Artificial Sequence: Synthetic peptide
LGS

SEQ ID NO: 591 - protein, 9 aa, Artificial Sequence
  Description of Artificial Sequence: Synthetic peptide
MQALQTPPT

SEQ ID NO: 592 - protein, 8 aa, Artificial Sequence
  Description of Artificial Sequence: Synthetic peptide
GFTFSSYA

SEQ ID NO: 593 - protein, 8 aa, Artificial Sequence
  Description of Artificial Sequence: Synthetic peptide
ISYDGSNK

SEQ ID NO: 594 - protein, 20 aa, Artificial Sequence
  Description of Artificial Sequence: Synthetic peptide
ARDVMVYCSSTSCYFYGMDV

SEQ ID NO: 595 - protein, 6 aa, Artificial Sequence
  Description of Artificial Sequence: Synthetic peptide
QDIRDY

SEQ ID NO: 596 - protein, 3 aa, Artificial Sequence
  Description of Artificial Sequence: Synthetic peptide
DAS

SEQ ID NO: 597 - protein, 9 aa, Artificial Sequence
  Description of Artificial Sequence: Synthetic peptide
QQFENLPIT

SEQ ID NO: 598 - protein, 8 aa, Artificial Sequence
  Description of Artificial Sequence: Synthetic peptide
GYTLTELS

SEQ ID NO: 599 - protein, 8 aa, Artificial Sequence
  Description of Artificial Sequence: Synthetic peptide
FDPEDGET

SEQ ID NO: 600 - protein, 18 aa, Artificial Sequence
  Description of Artificial Sequence: Synthetic peptide
ATGGYSSGFNYYYYYMDV

SEQ ID NO: 601 - protein, 11 aa, Artificial Sequence
  Description of Artificial Sequence: Synthetic peptide
QSLLYRNGNNY

SEQ ID NO: 602 - protein, 3 aa, Artificial Sequence
  Description of Artificial Sequence: Synthetic peptide
LGS

SEQ ID NO: 603 - protein, 9 aa, Artificial Sequence
  Description of Artificial Sequence: Synthetic peptide
MQALQTPPT

SEQ ID NO: 604 - protein, 8 aa, Artificial Sequence
  Description of Artificial Sequence: Synthetic peptide
GYTLTELS

SEQ ID NO: 605 - protein, 8 aa, Artificial Sequence
  Description of Artificial Sequence: Synthetic peptide
FDPEDGET

SEQ ID NO: 606 - protein, 14 aa, Artificial Sequence
  Description of Artificial Sequence: Synthetic peptide
ATGVTTYYYYGMDV

SEQ ID NO: 607 - protein, 11 aa, Artificial Sequence
  Description of Artificial Sequence: Synthetic peptide
QSLLYSNGNNF

SEQ ID NO: 608 - protein, 3 aa, Artificial Sequence
  Description of Artificial Sequence: Synthetic peptide
LGS

SEQ ID NO: 609 - protein, 9 aa, Artificial Sequence
  Description of Artificial Sequence: Synthetic peptide
MQALQTPPT

SEQ ID NO: 610 - protein, 8 aa, Artificial Sequence
  Description of Artificial Sequence: Synthetic peptide
GFTFSSYG

SEQ ID NO: 611 - protein, 8 aa, Artificial Sequence
  Description of Artificial Sequence: Synthetic peptide
IRYDGSNK

SEQ ID NO: 612 - protein, 14 aa, Artificial Sequence
  Description of Artificial Sequence: Synthetic peptide
ARDLFDFWWDGMDV

SEQ ID NO: 613 - protein, 7 aa, Artificial Sequence
  Description of Artificial Sequence: Synthetic peptide
QSVSSMY

SEQ ID NO: 614 - protein, 3 aa, Artificial Sequence
  Description of Artificial Sequence: Synthetic peptide
GAS

SEQ ID NO: 615 - protein, 10 aa, Artificial Sequence
  Description of Artificial Sequence: Synthetic peptide
QQYVSSPMYT

SEQ ID NO: 616 - protein, 8 aa, Artificial Sequence
  Description of Artificial Sequence: Synthetic peptide
GGTFSSSA

SEQ ID NO: 617 - protein, 8 aa, Artificial Sequence
  Description of Artificial Sequence: Synthetic peptide
IIPIYGIT

SEQ ID NO: 618 - protein, 22 aa, Artificial Sequence
  Description of Artificial Sequence: Synthetic peptide
ARDDTARRVRGVPYYYYYAMDV

SEQ ID NO: 619 - protein, 6 aa, Artificial Sequence
  Description of Artificial Sequence: Synthetic peptide
QSVSSY

SEQ ID NO: 620 - protein, 3 aa, Artificial Sequence
  Description of Artificial Sequence: Synthetic peptide
DAS

SEQ ID NO: 621 - protein, 9 aa, Artificial Sequence
  Description of Artificial Sequence: Synthetic peptide
QQYDDWPQT

SEQ ID NO: 622 - protein, 8 aa, Artificial Sequence
  Description of Artificial Sequence: Synthetic peptide
GGTFNNYG

SEQ ID NO: 623 - protein, 8 aa, Artificial Sequence
  Description of Artificial Sequence: Synthetic peptide
IIPLFGTT

SEQ ID NO: 624 - protein, 15 aa, Artificial Sequence
  Description of Artificial Sequence: Synthetic peptide
ARDRMAADGMAVFDY

SEQ ID NO: 625 - protein, 8 aa, Artificial Sequence
  Description of Artificial Sequence: Synthetic peptide
SSNIGRHF

SEQ ID NO: 626 - protein, 3 aa, Artificial Sequence
  Description of Artificial Sequence: Synthetic peptide
KND

SEQ ID NO: 627 - protein, 11 aa, Artificial Sequence
  Description of Artificial Sequence: Synthetic peptide
SSWDAALNGVV

SEQ ID NO: 628 - protein, 8 aa, Artificial Sequence
  Description of Artificial Sequence: Synthetic peptide
GYTLTELS

SEQ ID NO: 629 - protein, 8 aa, Artificial Sequence
  Description of Artificial Sequence: Synthetic peptide
FDPEDGET

SEQ ID NO: 630 - protein, 19 aa, Artificial Sequence
  Description of Artificial Sequence: Synthetic peptide
ATEVPMVRGARRYYYYMDV

SEQ ID NO: 631 - protein, 11 aa, Artificial Sequence
  Description of Artificial Sequence: Synthetic peptide
QTLLYINENNY

SEQ ID NO: 632 - protein, 3 aa, Artificial Sequence
  Description of Artificial Sequence: Synthetic peptide
LGS

SEQ ID NO: 633 - protein, 9 aa, Artificial Sequence
  Description of Artificial Sequence: Synthetic peptide
MQGLQTPPT

SEQ ID NO: 634 - protein, 10 aa, Artificial Sequence
  Description of Artificial Sequence: Synthetic peptide
GGSISNSNYY

SEQ ID NO: 635 - protein, 7 aa, Artificial Sequence
  Description of Artificial Sequence: Synthetic peptide
IYYSGST

SEQ ID NO: 636 - protein, 15 aa, Artificial Sequence
  Description of Artificial Sequence: Synthetic peptide
ARGAWELSLGDWFDP

SEQ ID NO: 637 - protein, 9 aa, Artificial Sequence
  Description of Artificial Sequence: Synthetic peptide
SSNIGAGYD

SEQ ID NO: 638 - protein, 3 aa, Artificial Sequence
  Description of Artificial Sequence: Synthetic peptide
GNN

SEQ ID NO: 639 - protein, 12 aa, Artificial Sequence
  Description of Artificial Sequence: Synthetic peptide
QSYDSSLSVYVV

SEQ ID NO: 640 - protein, 8 aa, Artificial Sequence
  Description of Artificial Sequence: Synthetic peptide
GGTFSSSA

SEQ ID NO: 641 - protein, 8 aa, Artificial Sequence
  Description of Artificial Sequence: Synthetic peptide
IIPIYGIT

SEQ ID NO: 642 - protein, 22 aa, Artificial Sequence
  Description of Artificial Sequence: Synthetic peptide
ARDDTARRVRGVPYYYYYAMDV

SEQ ID NO: 643 - protein, 6 aa, Artificial Sequence
  Description of Artificial Sequence: Synthetic peptide
QNVYGE

SEQ ID NO: 644 - protein, 3 aa, Artificial Sequence
  Description of Artificial Sequence: Synthetic peptide
DTF

SEQ ID NO: 645 - protein, 9 aa, Artificial Sequence
  Description of Artificial Sequence: Synthetic peptide
QQRRDWPIT

SEQ ID NO: 646 - protein, 8 aa, Artificial Sequence
  Description of Artificial Sequence: Synthetic peptide
GFTFGTSS

SEQ ID NO: 647 - protein, 8 aa, Artificial Sequence
  Description of Artificial Sequence: Synthetic peptide
ISFDGTEI

SEQ ID NO: 648 - protein, 15 aa, Artificial Sequence
  Description of Artificial Sequence: Synthetic peptide
AKGSGNIYFYSGMDV

SEQ ID NO: 649 - protein, 6 aa, Artificial Sequence
  Description of Artificial Sequence: Synthetic peptide
QSISGW

SEQ ID NO: 650 - protein, 3 aa, Artificial Sequence
  Description of Artificial Sequence: Synthetic peptide
ETS

SEQ ID NO: 651 - protein, 9 aa, Artificial Sequence
  Description of Artificial Sequence: Synthetic peptide
QQYYSYPLT

SEQ ID NO: 652 - protein, 8 aa, Artificial Sequence
  Description of Artificial Sequence: Synthetic peptide
GYTLTELS

SEQ ID NO: 653 - protein, 8 aa, Artificial Sequence
  Description of Artificial Sequence: Synthetic peptide
FDPEDGET

SEQ ID NO: 654 - protein, 19 aa, Artificial Sequence
  Description of Artificial Sequence: Synthetic peptide
ATGVPAAIGVYYYYYYMDV

SEQ ID NO: 655 - protein, 11 aa, Artificial Sequence
  Description of Artificial Sequence: Synthetic peptide
QSLLYSNGYNY

SEQ ID NO: 656 - protein, 3 aa, Artificial Sequence
  Description of Artificial Sequence: Synthetic peptide
LGS

SEQ ID NO: 657 - protein, 9 aa, Artificial Sequence
  Description of Artificial Sequence: Synthetic peptide
MQALQSPVT

SEQ ID NO: 658 - protein, 8 aa, Artificial Sequence
  Description of Artificial Sequence: Synthetic peptide
GYTLTELS

SEQ ID NO: 659 - protein, 8 aa, Artificial Sequence
  Description of Artificial Sequence: Synthetic peptide
FDPEDGET

SEQ ID NO: 660 - protein, 20 aa, Artificial Sequence
  Description of Artificial Sequence: Synthetic peptide
ATDSRDGPAARGGYYYYMDV

SEQ ID NO: 661 - protein, 11 aa, Artificial Sequence
  Description of Artificial Sequence: Synthetic peptide
QSLLYINGYNY

SEQ ID NO: 662 - protein, 3 aa, Artificial Sequence
  Description of Artificial Sequence: Synthetic peptide
LGS

SEQ ID NO: 663 - protein, 9 aa, Artificial Sequence
  Description of Artificial Sequence: Synthetic peptide
MQALQTPPT

SEQ ID NO: 664 - protein, 8 aa, Artificial Sequence
  Description of Artificial Sequence: Synthetic peptide
GGTFSSYA

SEQ ID NO: 665 - protein, 8 aa, Artificial Sequence
  Description of Artificial Sequence: Synthetic peptide
IIPIFGTA

SEQ ID NO: 666 - protein, 20 aa, Artificial Sequence
  Description of Artificial Sequence: Synthetic peptide
ARDAYYYDSSGYYNPDAFDI

SEQ ID NO: 667 - protein, 11 aa, Artificial Sequence
  Description of Artificial Sequence: Synthetic peptide
QSLLHSNGYNY

SEQ ID NO: 668 - protein, 3 aa, Artificial Sequence
  Description of Artificial Sequence: Synthetic peptide
LGS

SEQ ID NO: 669 - protein, 9 aa, Artificial Sequence
  Description of Artificial Sequence: Synthetic peptide
MQGLQTPRT

SEQ ID NO: 670 - protein, 10 aa, Artificial Sequence
  Description of Artificial Sequence: Synthetic peptide
GFSLTSGGMS

SEQ ID NO: 671 - protein, 7 aa, Artificial Sequence
  Description of Artificial Sequence: Synthetic peptide
IDWNDDK

SEQ ID NO: 672 - protein, 12 aa, Artificial Sequence
  Description of Artificial Sequence: Synthetic peptide
ARIRGMTWGFDS

SEQ ID NO: 673 - protein, 7 aa, Artificial Sequence
  Description of Artificial Sequence: Synthetic peptide
QSVSSSY

SEQ ID NO: 674 - protein, 3 aa, Artificial Sequence
  Description of Artificial Sequence: Synthetic peptide
GAS

SEQ ID NO: 675 - protein, 9 aa, Artificial Sequence
  Description of Artificial Sequence: Synthetic peptide
QQYGTTPFA

SEQ ID NO: 676 - protein, 8 aa, Artificial Sequence
  Description of Artificial Sequence: Synthetic peptide
GYTFTAYY

SEQ ID NO: 677 - protein, 8 aa, Artificial Sequence
  Description of Artificial Sequence: Synthetic peptide
INPNSGGT

SEQ ID NO: 678 - protein, 21 aa, Artificial Sequence
  Description of Artificial Sequence: Synthetic peptide
ARDGAFYYGSENYYNAGWFDP

SEQ ID NO: 679 - protein, 11 aa, Artificial Sequence
  Description of Artificial Sequence: Synthetic peptide
QSLLSGNGYNY

SEQ ID NO: 680 - protein, 3 aa, Artificial Sequence
  Description of Artificial Sequence: Synthetic peptide
LGS

SEQ ID NO: 681 - protein, 9 aa, Artificial Sequence
  Description of Artificial Sequence: Synthetic peptide
MQALKSPLT

SEQ ID NO: 682 - protein, 8 aa, Artificial Sequence
  Description of Artificial Sequence: Synthetic peptide
GYTFTNYY

SEQ ID NO: 683 - protein, 8 aa, Artificial Sequence
  Description of Artificial Sequence: Synthetic peptide
INPSGGIT

SEQ ID NO: 684 - protein, 18 aa, Artificial Sequence
  Description of Artificial Sequence: Synthetic peptide
ARAGLGYNWNYAPSGMDV

SEQ ID NO: 685 - protein, 9 aa, Artificial Sequence
  Description of Artificial Sequence: Synthetic peptide
SSDVGGYNY

SEQ ID NO: 686 - protein, 3 aa, Artificial Sequence
  Description of Artificial Sequence: Synthetic peptide
EVS

SEQ ID NO: 687 - protein, 10 aa, Artificial Sequence
  Description of Artificial Sequence: Synthetic peptide
SSYAGSNNLV

SEQ ID NO: 688 - protein, 10 aa, Artificial Sequence
  Description of Artificial Sequence: Synthetic peptide
GGSISSSSYY

SEQ ID NO: 689 - protein, 7 aa, Artificial Sequence
  Description of Artificial Sequence: Synthetic peptide
IYYSGST

SEQ ID NO: 690 - protein, 15 aa, Artificial Sequence
  Description of Artificial Sequence: Synthetic peptide
ARGAWELRLGDWFDP

SEQ ID NO: 691 - protein, 9 aa, Artificial Sequence
  Description of Artificial Sequence: Synthetic peptide
SSNIGAGYD

SEQ ID NO: 692 - protein, 3 aa, Artificial Sequence
  Description of Artificial Sequence: Synthetic peptide
GYS

SEQ ID NO: 693 - protein, 12 aa, Artificial Sequence
  Description of Artificial Sequence: Synthetic peptide
QSYDSSLSVYVV

SEQ ID NO: 694 - protein, 8 aa, Artificial Sequence
  Description of Artificial Sequence: Synthetic peptide
GFTFDDYA

SEQ ID NO: 695 - protein, 8 aa, Artificial Sequence
  Description of Artificial Sequence: Synthetic peptide
ISWNSGSI

SEQ ID NO: 696 - protein, 15 aa, Artificial Sequence
  Description of Artificial Sequence: Synthetic peptide
AKDVNRILVAGMVDY

SEQ ID NO: 697 - protein, 11 aa, Artificial Sequence
  Description of Artificial Sequence: Synthetic peptide
QSLLHSNGYNY

SEQ ID NO: 698 - protein, 3 aa, Artificial Sequence
  Description of Artificial Sequence: Synthetic peptide
LGS

SEQ ID NO: 699 - protein, 9 aa, Artificial Sequence
  Description of Artificial Sequence: Synthetic peptide
MQGLQTPIT

SEQ ID NO: 700 - protein, 8 aa, Artificial Sequence
  Description of Artificial Sequence: Synthetic peptide
RFTFEDYA

SEQ ID NO: 701 - protein, 8 aa, Artificial Sequence
  Description of Artificial Sequence: Synthetic peptide
ISWKSGGI

SEQ ID NO: 702 - protein, 15 aa, Artificial Sequence
  Description of Artificial Sequence: Synthetic peptide
VKDPTLVATDRAFNI

SEQ ID NO: 703 - protein, 11 aa, Artificial Sequence
  Description of Artificial Sequence: Synthetic peptide
QSLLHSNGYNY

SEQ ID NO: 704 - protein, 3 aa, Artificial Sequence
  Description of Artificial Sequence: Synthetic peptide
LGS

SEQ ID NO: 705 - protein, 9 aa, Artificial Sequence
  Description of Artificial Sequence: Synthetic peptide
MQYLQTPDT

SEQ ID NO: 706 - protein, 8 aa, Artificial Sequence
  Description of Artificial Sequence: Synthetic peptide
GGTFSSSA

SEQ ID NO: 707 - protein, 8 aa, Artificial Sequence
  Description of Artificial Sequence: Synthetic peptide
IIPIYGIT

SEQ ID NO: 708 - protein, 22 aa, Artificial Sequence
  Description of Artificial Sequence: Synthetic peptide
ARDDTARRVRGVPYYYYYAMDV

SEQ ID NO: 709 - protein, 12 aa, Artificial Sequence
  Description of Artificial Sequence: Synthetic peptide
QSLLDSDDGNIH

SEQ ID NO: 710 - protein, 3 aa, Artificial Sequence
  Description of Artificial Sequence: Synthetic peptide
TLS

SEQ ID NO: 711 - protein, 9 aa, Artificial Sequence
  Description of Artificial Sequence: Synthetic peptide
MQRKEFPLT

SEQ ID NO: 712 - protein, 8 aa, Artificial Sequence
  Description of Artificial Sequence: Synthetic peptide
GFTFSSYG

SEQ ID NO: 713 - protein, 8 aa, Artificial Sequence
  Description of Artificial Sequence: Synthetic peptide
ISYDGSNK

SEQ ID NO: 714 - protein, 18 aa, Artificial Sequence
  Description of Artificial Sequence: Synthetic peptide
AKEDRLRFLEWLFYGMDV

SEQ ID NO: 715 - protein, 6 aa, Artificial Sequence
  Description of Artificial Sequence: Synthetic peptide
HDIYTY

SEQ ID NO: 716 - protein, 3 aa, Artificial Sequence
  Description of Artificial Sequence: Synthetic peptide
DAS

SEQ ID NO: 717 - protein, 11 aa, Artificial Sequence
  Description of Artificial Sequence: Synthetic peptide
QQYDNHPPEVT

SEQ ID NO: 718 - protein, 8 aa, Artificial Sequence
  Description of Artificial Sequence: Synthetic peptide
GGTFSSSA

SEQ ID NO: 719 - protein, 8 aa, Artificial Sequence
  Description of Artificial Sequence: Synthetic peptide
IIPIYGIT

SEQ ID NO: 720 - protein, 22 aa, Artificial Sequence
  Description of Artificial Sequence: Synthetic peptide
ARDDTARRVRGVPYYYYYAMDV

SEQ ID NO: 721 - protein, 6 aa, Artificial Sequence
  Description of Artificial Sequence: Synthetic peptide
QDIDDD

SEQ ID NO: 722 - protein, 3 aa, Artificial Sequence
  Description of Artificial Sequence: Synthetic peptide
EAS

SEQ ID NO: 723 - protein, 9 aa, Artificial Sequence
  Description of Artificial Sequence: Synthetic peptide
LQHDNLPLT

SEQ ID NO: 724 - protein, 8 aa, Artificial Sequence
  Description of Artificial Sequence: Synthetic peptide
GYTLTELS

SEQ ID NO: 725 - protein, 8 aa, Artificial Sequence
  Description of Artificial Sequence: Synthetic peptide
FDPEDGET

SEQ ID NO: 726 - protein, 19 aa, Artificial Sequence
  Description of Artificial Sequence: Synthetic peptide
ATEDPGPVAGPYYYYGMDV

SEQ ID NO: 727 - protein, 11 aa, Artificial Sequence
  Description of Artificial Sequence: Synthetic peptide
QSLLYINGYHY

SEQ ID NO: 728 - protein, 3 aa, Artificial Sequence
  Description of Artificial Sequence: Synthetic peptide
LGS

SEQ ID NO: 729 - protein, 9 aa, Artificial Sequence
  Description of Artificial Sequence: Synthetic peptide
MQALQTPPT

SEQ ID NO: 730 - protein, 8 aa, Artificial Sequence
  Description of Artificial Sequence: Synthetic peptide
GYMFTNYP

SEQ ID NO: 731 - protein, 8 aa, Artificial Sequence
  Description of Artificial Sequence: Synthetic peptide
INAGTGNT

SEQ ID NO: 732 - protein, 21 aa, Artificial Sequence
  Description of Artificial Sequence: Synthetic peptide
AREGMFYYGLESYYKGGWFDP

SEQ ID NO: 733 - protein, 11 aa, Artificial Sequence
  Description of Artificial Sequence: Synthetic peptide
QSLLHRNGYNY

SEQ ID NO: 734 - protein, 3 aa, Artificial Sequence
  Description of Artificial Sequence: Synthetic peptide
LAS

SEQ ID NO: 735 - protein, 9 aa, Artificial Sequence
  Description of Artificial Sequence: Synthetic peptide
MQALQTPLT

SEQ ID NO: 736 - protein, 8 aa, Artificial Sequence
  Description of Artificial Sequence: Synthetic peptide
GGTFSSSA

SEQ ID NO: 737 - protein, 8 aa, Artificial Sequence
  Description of Artificial Sequence: Synthetic peptide
IIPIYGIT

SEQ ID NO: 738 - protein, 22 aa, Artificial Sequence
  Description of Artificial Sequence: Synthetic peptide
ARDDTARRVRGVPYYYYYAMDV

SEQ ID NO: 739 - protein, 12 aa, Artificial Sequence
  Description of Artificial Sequence: Synthetic peptide
QSLLDSDDGNTY

SEQ ID NO: 740 - protein, 3 aa, Artificial Sequence
  Description of Artificial Sequence: Synthetic peptide
TLS

SEQ ID NO: 741 - protein, 9 aa, Artificial Sequence
  Description of Artificial Sequence: Synthetic peptide
MQRLQFPLT

SEQ ID NO: 742 - protein, 8 aa, Artificial Sequence
  Description of Artificial Sequence: Synthetic peptide
TYTFTTYY

SEQ ID NO: 743 - protein, 8 aa, Artificial Sequence
  Description of Artificial Sequence: Synthetic peptide
IYPSGGNT

SEQ ID NO: 744 - protein, 13 aa, Artificial Sequence
  Description of Artificial Sequence: Synthetic peptide
VRDQNYYYSAMDV

SEQ ID NO: 745 - protein, 6 aa, Artificial Sequence
  Description of Artificial Sequence: Synthetic peptide
QDIRNY

SEQ ID NO: 746 - protein, 3 aa, Artificial Sequence
  Description of Artificial Sequence: Synthetic peptide
DAS

SEQ ID NO: 747 - protein, 9 aa, Artificial Sequence
  Description of Artificial Sequence: Synthetic peptide
QQFENLPIT

SEQ ID NO: 748 - protein, 8 aa, Artificial Sequence
  Description of Artificial Sequence: Synthetic peptide
GGTFSSSA

SEQ ID NO: 749 - protein, 8 aa, Artificial Sequence
  Description of Artificial Sequence: Synthetic peptide
IIPIYGIT

SEQ ID NO: 750 - protein, 22 aa, Artificial Sequence
  Description of Artificial Sequence: Synthetic peptide
ARDDTARRVRGVPYYYYYAMDV

SEQ ID NO: 751 - protein, 6 aa, Artificial Sequence
  Description of Artificial Sequence: Synthetic peptide
RDISDS

SEQ ID NO: 752 - protein, 3 aa, Artificial Sequence
  Description of Artificial Sequence: Synthetic peptide
DAS

SEQ ID NO: 753 - protein, 9 aa, Artificial Sequence
  Description of Artificial Sequence: Synthetic peptide
HQYDNLPLT

SEQ ID NO: 754 - protein, 8 aa, Artificial Sequence
  Description of Artificial Sequence: Synthetic peptide
GFNFRGYA

SEQ ID NO: 755 - protein, 8 aa, Artificial Sequence
  Description of Artificial Sequence: Synthetic peptide
ISGSGGTT

SEQ ID NO: 756 - protein, 15 aa, Artificial Sequence
  Description of Artificial Sequence: Synthetic peptide
AQSYAQIGYGGHIDH

SEQ ID NO: 757 - protein, 9 aa, Artificial Sequence
  Description of Artificial Sequence: Synthetic peptide
SGIDVATYM

SEQ ID NO: 758 - protein, 7 aa, Artificial Sequence
  Description of Artificial Sequence: Synthetic peptide
YKSDSDK

SEQ ID NO: 759 - protein, 9 aa, Artificial Sequence
  Description of Artificial Sequence: Synthetic peptide
LIWHGSHYV

SEQ ID NO: 760 - protein, 8 aa, Artificial Sequence
  Description of Artificial Sequence: Synthetic peptide
GYTLTELS

SEQ ID NO: 761 - protein, 8 aa, Artificial Sequence
  Description of Artificial Sequence: Synthetic peptide
FDPEDGET

SEQ ID NO: 762 - protein, 19 aa, Artificial Sequence
  Description of Artificial Sequence: Synthetic peptide
ATGVPAAIGVYYYYYYMDV

SEQ ID NO: 763 - protein, 11 aa, Artificial Sequence
  Description of Artificial Sequence: Synthetic peptide
QSLLYRNGYNY

SEQ ID NO: 764 - protein, 3 aa, Artificial Sequence
  Description of Artificial Sequence: Synthetic peptide
WGS

SEQ ID NO: 765 - protein, 9 aa, Artificial Sequence
  Description of Artificial Sequence: Synthetic peptide
MQAVQNPPT

SEQ ID NO: 766 - protein, 8 aa, Artificial Sequence
  Description of Artificial Sequence: Synthetic peptide
GGTFSSSA

SEQ ID NO: 767 - protein, 8 aa, Artificial Sequence
  Description of Artificial Sequence: Synthetic peptide
IIPIYGIT

SEQ ID NO: 768 - protein, 22 aa, Artificial Sequence
  Description of Artificial Sequence: Synthetic peptide
ARDDTARRVRGVPYYYYYAMDV

SEQ ID NO: 769 - protein, 6 aa, Artificial Sequence
  Description of Artificial Sequence: Synthetic peptide
QNIDSS

SEQ ID NO: 770 - protein, 3 aa, Artificial Sequence
  Description of Artificial Sequence: Synthetic peptide
YAS

SEQ ID NO: 771 - protein, 9 aa, Artificial Sequence
  Description of Artificial Sequence: Synthetic peptide
HQSSSLPLT

SEQ ID NO: 772 - protein, 8 aa, Artificial Sequence
  Description of Artificial Sequence: Synthetic peptide
GGTFSSSA

SEQ ID NO: 773 - protein, 8 aa, Artificial Sequence
  Description of Artificial Sequence: Synthetic peptide
IIPIYGIT

SEQ ID NO: 774 - protein, 22 aa, Artificial Sequence
  Description of Artificial Sequence: Synthetic peptide
ARDDTARRVRGVPYYYYYAMDV

SEQ ID NO: 775 - protein, 7 aa, Artificial Sequence
  Description of Artificial Sequence: Synthetic peptide
QSVYNNY

SEQ ID NO: 776 - protein, 3 aa, Artificial Sequence
  Description of Artificial Sequence: Synthetic peptide
DAS

SEQ ID NO: 777 - protein, 10 aa, Artificial Sequence
  Description of Artificial Sequence: Synthetic peptide
QQYNSWPPYT

SEQ ID NO: 778 - protein, 8 aa, Artificial Sequence
  Description of Artificial Sequence: Synthetic peptide
GGTFSSYA

SEQ ID NO: 779 - protein, 8 aa, Artificial Sequence
  Description of Artificial Sequence: Synthetic peptide
IIPIFGTA

SEQ ID NO: 780 - protein, 20 aa, Artificial Sequence
  Description of Artificial Sequence: Synthetic peptide
ARDAYYYDSSGYYNPDAFDI

SEQ ID NO: 781 - protein, 11 aa, Artificial Sequence
  Description of Artificial Sequence: Synthetic peptide
QSLLYSNGYNY

SEQ ID NO: 782 - protein, 3 aa, Artificial Sequence
  Description of Artificial Sequence: Synthetic peptide
LGS

SEQ ID NO: 783 - protein, 9 aa, Artificial Sequence
  Description of Artificial Sequence: Synthetic peptide
MQARQTPYT

SEQ ID NO: 784 - protein, 8 aa, Artificial Sequence
  Description of Artificial Sequence: Synthetic peptide
GGTFSSSA

SEQ ID NO: 785 - protein, 8 aa, Artificial Sequence
  Description of Artificial Sequence: Synthetic peptide
IIPIYGIT

SEQ ID NO: 786 - protein, 22 aa, Artificial Sequence
  Description of Artificial Sequence: Synthetic peptide
ARDDTARRVRGVPYYYYYAMDV

SEQ ID NO: 787 - protein, 6 aa, Artificial Sequence
  Description of Artificial Sequence: Synthetic peptide
ESVTTF

SEQ ID NO: 788 - protein, 3 aa, Artificial Sequence
  Description of Artificial Sequence: Synthetic peptide
DAS

SEQ ID NO: 789 - protein, 9 aa, Artificial Sequence
  Description of Artificial Sequence: Synthetic peptide
HQHTNWPLT

SEQ ID NO: 790 - protein, 8 aa, Artificial Sequence
  Description of Artificial Sequence: Synthetic peptide
GYTLTELS

SEQ ID NO: 791 - protein, 8 aa, Artificial Sequence
  Description of Artificial Sequence: Synthetic peptide
FDPEDGET

SEQ ID NO: 792 - protein, 22 aa, Artificial Sequence
  Description of Artificial Sequence: Synthetic peptide
ATEVGYCSGGSCYISYYYGMDV

SEQ ID NO: 793 - protein, 11 aa, Artificial Sequence
  Description of Artificial Sequence: Synthetic peptide
QSLLYRNGHNF

SEQ ID NO: 794 - protein, 3 aa, Artificial Sequence
  Description of Artificial Sequence: Synthetic peptide
LGS

SEQ ID NO: 795 - protein, 9 aa, Artificial Sequence
  Description of Artificial Sequence: Synthetic peptide
MQALQTPPT

SEQ ID NO: 796 - protein, 8 aa, Artificial Sequence
  Description of Artificial Sequence: Synthetic peptide
GGTFSSSA

SEQ ID NO: 797 - protein, 8 aa, Artificial Sequence
  Description of Artificial Sequence: Synthetic peptide
IIPIYGIT

SEQ ID NO: 798 - protein, 22 aa, Artificial Sequence
  Description of Artificial Sequence: Synthetic peptide
ARDDTARRVRGVPYYYYYAMDV

SEQ ID NO: 799 - protein, 6 aa, Artificial Sequence
  Description of Artificial Sequence: Synthetic peptide
QTMNNY

SEQ ID NO: 800 - protein, 3 aa, Artificial Sequence
  Description of Artificial Sequence: Synthetic peptide
DAS

SEQ ID NO: 801 - protein, 10 aa, Artificial Sequence
  Description of Artificial Sequence: Synthetic peptide
QQYGDWLPIT

SEQ ID NO: 802 - protein, 8 aa, Artificial Sequence
  Description of Artificial Sequence: Synthetic peptide
GYTLTELS

SEQ ID NO: 803 - protein, 8 aa, Artificial Sequence
  Description of Artificial Sequence: Synthetic peptide
FDPEDGET

SEQ ID NO: 804 - protein, 17 aa, Artificial Sequence
  Description of Artificial Sequence: Synthetic peptide
ATAFPEATISYYYYMDV

SEQ ID NO: 805 - protein, 11 aa, Artificial Sequence
  Description of Artificial Sequence: Synthetic peptide
QSLLYRNGYNY

SEQ ID NO: 806 - protein, 3 aa, Artificial Sequence
  Description of Artificial Sequence: Synthetic peptide
WGS

SEQ ID NO: 807 - protein, 9 aa, Artificial Sequence
  Description of Artificial Sequence: Synthetic peptide
MQAVQNPPT

SEQ ID NO: 808 - protein, 8 aa, Artificial Sequence
  Description of Artificial Sequence: Synthetic peptide
GGTFSSSA

SEQ ID NO: 809 - protein, 8 aa, Artificial Sequence
  Description of Artificial Sequence: Synthetic peptide
IIPIYGIT

SEQ ID NO: 810 - protein, 22 aa, Artificial Sequence
  Description of Artificial Sequence: Synthetic peptide
ARDDTARRVRGVPYYYYYAMDV

SEQ ID NO: 811 - protein, 12 aa, Artificial Sequence
  Description of Artificial Sequence: Synthetic peptide
RSLLDSDDGNTH

SEQ ID NO: 812 - protein, 3 aa, Artificial Sequence
  Description of Artificial Sequence: Synthetic peptide
SLS

SEQ ID NO: 813 - protein, 9 aa, Artificial Sequence
  Description of Artificial Sequence: Synthetic peptide
MQRKEFPLT

SEQ ID NO: 814 - protein, 8 aa, Artificial Sequence
  Description of Artificial Sequence: Synthetic peptide
GGTFSSYA

SEQ ID NO: 815 - protein, 8 aa, Artificial Sequence
  Description of Artificial Sequence: Synthetic peptide
IIPIFGTA

SEQ ID NO: 816 - protein, 21 aa, Artificial Sequence
  Description of Artificial Sequence: Synthetic peptide
ARGPWYYDSSGYSSYAYYMDV

SEQ ID NO: 817 - protein, 11 aa, Artificial Sequence
  Description of Artificial Sequence: Synthetic peptide
QSLLHSDGYNY

SEQ ID NO: 818 - protein, 3 aa, Artificial Sequence
  Description of Artificial Sequence: Synthetic peptide
LGS

SEQ ID NO: 819 - protein, 10 aa, Artificial Sequence
  Description of Artificial Sequence: Synthetic peptide
MQALHTPGVT

SEQ ID NO: 820 - protein, 121 aa, Artificial Sequence
  Description of Artificial Sequence: Synthetic polypeptide
DVQLVESGGDLVQPGGSRKLSCTASGFTFSNFGMHWVRQAPEKGLEWVAYISSGSSTIYYADTVKGRFTISRDNPENTLFLQMTSLRSEDTAMYYCTRLDYYTNSYSMDHWGQGTSVTVSS

SEQ ID NO: 821 - protein, 8 aa, Artificial Sequence
  Description of Artificial Sequence: Synthetic peptide
GFTFSNFG

SEQ ID NO: 822 - protein, 8 aa, Artificial Sequence
  Description of Artificial Sequence: Synthetic peptide
ISSGSSTI

SEQ ID NO: 823 - protein, 14 aa, Artificial Sequence
  Description of Artificial Sequence: Synthetic peptide
TRLDYYTNSYSMDH

SEQ ID NO: 824 - protein, 106 aa, Artificial Sequence
  Description of Artificial Sequence: Synthetic polypeptide
QIVLTQSPALMSASPGEKVTLTCSASSSLPYIYWYQQKPGSSPKPWIYLTSNLASGVPARFSGSRSGTSYSLTISSVEAEDAATYYCQQWSSNPFTFGSGTKLEIK

SEQ ID NO: 825 - protein, 5 aa, Artificial Sequence
  Description of Artificial Sequence: Synthetic peptide
SSLPY

SEQ ID NO: 826 - protein, 3 aa, Artificial Sequence
  Description of Artificial Sequence: Synthetic peptide
LTS

SEQ ID NO: 827 - protein, 9 aa, Artificial Sequence
  Description of Artificial Sequence: Synthetic peptide
QQWSSNPFT

SEQ ID NO: 828 - protein, 117 aa, Artificial Sequence
  Description of Artificial Sequence: Synthetic polypeptide
QVQLQQSGAELAKPGASVKMSCKASGYTFTSNWMHWVKQRPGQGLEWIGYINPSNGYTECNQKFRDKATLSADKSSSTAYMQLNSLTSADSAVYYCALMISAWLPYWGQGTLVTVSA

SEQ ID NO: 829 - protein, 8 aa, Artificial Sequence
  Description of Artificial Sequence: Synthetic peptide
GYTFTSNW

SEQ ID NO: 830 - protein, 8 aa, Artificial Sequence
  Description of Artificial Sequence: Synthetic peptide
INPSNGYT

SEQ ID NO: 831 - protein, 10 aa, Artificial Sequence
  Description of Artificial Sequence: Synthetic peptide
ALMISAWLPY

SEQ ID NO: 832 - protein, 111 aa, Artificial Sequence
  Description of Artificial Sequence: Synthetic polypeptide
DIVLTQSPASLAISLGQRATISCRASQSVSASSYSYVHWYQQKPGQPPKLLIKYASSLESGVPARFSGSGSGTDFTLNIHPVEEEDTATYYCLHTWEIPYTFGGGTKLEIK

SEQ ID NO: 833 - protein, 10 aa, Artificial Sequence
  Description of Artificial Sequence: Synthetic peptide
QSVSASSYSY

SEQ ID NO: 834 - protein, 3 aa, Artificial Sequence
  Description of Artificial Sequence: Synthetic peptide
YAS

SEQ ID NO: 835 - protein, 9 aa, Artificial Sequence
  Description of Artificial Sequence: Synthetic peptide
LHTWEIPYT

SEQ ID NO: 836 - protein, 116 aa, Artificial Sequence
  Description of Artificial Sequence: Synthetic polypeptide
QVQLQQSGAELTRPGASVNLSCKASGYTFTSYWMQWVKQRPGQGLEWIGAIYPGDGDTRFNQKFKGKATLTADESSSTAYMQLSSLASEDSAVYYCATYYRYDDYWGQGTTLTVSS

SEQ ID NO: 837 - protein, 8 aa, Artificial Sequence
  Description of Artificial Sequence: Synthetic peptide
GYTFTSYW

SEQ ID NO: 838 - protein, 8 aa, Artificial Sequence
  Description of Artificial Sequence: Synthetic peptide
IYPGDGDT

SEQ ID NO: 839 - protein, 9 aa, Artificial Sequence
  Description of Artificial Sequence: Synthetic peptide
ATYYRYDDY

SEQ ID NO: 840 - protein, 106 aa, Artificial Sequence
  Description of Artificial Sequence: Synthetic polypeptide
QIVLTQSPAIMSASPGEKVTMTCSASSSVSYMHWYQQKSGTSPKRWIYDTSKLASGVPTRFSGSGSGTSYSLTISSMEAEDAATYYCQQWSSNPYTFGGGTKLEIK

SEQ ID NO: 841 - protein, 5 aa, Artificial Sequence
  Description of Artificial Sequence: Synthetic peptide
SSVSY

SEQ ID NO: 842 - protein, 3 aa, Artificial Sequence
  Description of Artificial Sequence: Synthetic peptide
DTS

SEQ ID NO: 843 - protein, 9 aa, Artificial Sequence
  Description of Artificial Sequence: Synthetic peptide
QQWSSNPYT

SEQ ID NO: 844 - protein, 122 aa, Artificial Sequence
  Description of Artificial Sequence: Synthetic polypeptide
EVQLQQSGPDLVKPGASMKISCKASGYTFIDYNIHWVKQSQGKSLDWIGYIYPYNGGTGYNQKFKNKATLTVDSSSSTAYMEVRSLTFEDSAVYFCAREADYYGNRGQFDYWGQGTLVTVSA

SEQ ID NO: 845 - protein, 8 aa, Artificial Sequence
  Description of Artificial Sequence: Synthetic peptide
GYTFIDYN

SEQ ID NO: 846 - protein, 8 aa, Artificial Sequence
  Description of Artificial Sequence: Synthetic peptide
IYPYNGGT

SEQ ID NO: 847 - protein, 15 aa, Artificial Sequence
  Description of Artificial Sequence: Synthetic peptide
AREADYYGNRGQFDY

SEQ ID NO: 848 - protein, 107 aa, Artificial Sequence
  Description of Artificial Sequence: Synthetic polypeptide
DIQMTQSPASLSVSVGETVTITCRASENIFSNLAWYQQKQGKSPQLLVYGEANLADGVPSRFSGSGSGTQYSLKINSLQSEDFGNYYCQHFWGTPYTFGGGTTLEIK

SEQ ID NO: 849 - protein, 6 aa, Artificial Sequence
  Description of Artificial Sequence: Synthetic peptide
ENIFSN

SEQ ID NO: 850 - protein, 3 aa, Artificial Sequence
  Description of Artificial Sequence: Synthetic peptide
GEA

SEQ ID NO: 851 - protein, 9 aa, Artificial Sequence
  Description of Artificial Sequence: Synthetic peptide
QHFWGTPYT

SEQ ID NO: 852 - protein, 120 aa, Artificial Sequence
  Description of Artificial Sequence: Synthetic polypeptide
QVTLKESGPGILQPSQTLSLTCSFSGFSLNTSGTGVGWIRQPSGKGLEWLTHIWWNDNKFYNTFLKSRLTISKETSNNQVFLKIASVDTADAATYYCARMAYGNLWFVNWGQGTLVAVST

SEQ ID NO: 853 - protein, 10 aa, Artificial Sequence
  Description of Artificial Sequence: Synthetic peptide
GFSLNTSGTG

SEQ ID NO: 854 - protein, 7 aa, Artificial Sequence
  Description of Artificial Sequence: Synthetic peptide
IWWNDNK

SEQ ID NO: 855 - protein, 12 aa, Artificial Sequence
  Description of Artificial Sequence: Synthetic peptide
ARMAYGNLWFVN

SEQ ID NO: 856 - protein, 111 aa, Artificial Sequence
  Description of Artificial Sequence: Synthetic polypeptide
DIVLTQSPASLAVSLGQRASISCRASRSVTISGYSYMYWYQQKPGQPPRLLFYLASNLASGVPARFSGSGSGTDFTLNIHPVEEEDAAIYYCQHSRELPYTFGGGTKLEIK

SEQ ID NO: 857 - protein, 10 aa, Artificial Sequence
  Description of Artificial Sequence: Synthetic peptide
RSVTISGYSY

SEQ ID NO: 858 - protein, 3 aa, Artificial Sequence
  Description of Artificial Sequence: Synthetic peptide
LAS

SEQ ID NO: 859 - protein, 9 aa, Artificial Sequence
  Description of Artificial Sequence: Synthetic peptide
QHSRELPYT

SEQ ID NO: 860 - protein, 123 aa, Artificial Sequence
  Description of Artificial Sequence: Synthetic polypeptide
QIQLVQSGPELKKPRETVKISCKASGYTFTDYSMHWVKQAPGKGLKWMGWINTETGEPTYADDFKGRFAFSLEASASSAYLQINILKDEDTATYFCARSRGGYYEDYYALDYWGQGTSVTVSS

SEQ ID NO: 861 - protein, 8 aa, Artificial Sequence
  Description of Artificial Sequence: Synthetic peptide
GYTFTDYS

SEQ ID NO: 862 - protein, 8 aa, Artificial Sequence
  Description of Artificial Sequence: Synthetic peptide
INTETGEP

SEQ ID NO: 863 - protein, 16 aa, Artificial Sequence
  Description of Artificial Sequence: Synthetic peptide
ARSRGGYYEDYYALDY

SEQ ID NO: 864 - protein, 107 aa, Artificial Sequence
  Description of Artificial Sequence: Synthetic polypeptide
DIQMTQSPASLSASVGESVTITCRASGNIHYYLAWYQQKQGKSPQLLVYNAKNLADGVPSRFSGSGSGTQFSLKINSLQPEDFGSYYCQHFWISPPTFGGGTKLEIK

SEQ ID NO: 865 - protein, 6 aa, Artificial Sequence
  Description of Artificial Sequence: Synthetic peptide
GNIHYY

SEQ ID NO: 866 - protein, 3 aa, Artificial Sequence
  Description of Artificial Sequence: Synthetic peptide
NAK

SEQ ID NO: 867 - protein, 9 aa, Artificial Sequence
  Description of Artificial Sequence: Synthetic peptide
QHFWISPPT

SEQ ID NO: 868 - protein, 118 aa, Artificial Sequence
  Description of Artificial Sequence: Synthetic polypeptide
EVQLRQSGADLVKPGASVKLSCTASGFNIKDTYIDWVKQRPEQGLDWIGRIDPANGNTKYDPKFQGKATIITDTSSNTAYLQLSNLTSEDTAVYYCARYGSYPYFDYWGRGTTLAVSS

SEQ ID NO: 869 - protein, 8 aa, Artificial Sequence
  Description of Artificial Sequence: Synthetic peptide
GFNIKDTY

SEQ ID NO: 870 - protein, 8 aa, Artificial Sequence
  Description of Artificial Sequence: Synthetic peptide
IDPANGNT

SEQ ID NO: 871 - protein, 11 aa, Artificial Sequence
  Description of Artificial Sequence: Synthetic peptide
ARYGSYPYFDY

SEQ ID NO: 872 - protein, 107 aa, Artificial Sequence
  Description of Artificial Sequence: Synthetic polypeptide
SIVMTQTPKFLLISAGDRVTITCKASQSVRNDVAWYQQKPGQSPKLLMYYASNRYTGVPDRFTGSGYGTDFTFTISTVQAEDLAVYFCQQDYSSPPTFGGGTKLEIK

SEQ ID NO: 873 - protein, 6 aa, Artificial Sequence
  Description of Artificial Sequence: Synthetic peptide
QSVRND

SEQ ID NO: 874 - protein, 3 aa, Artificial Sequence
  Description of Artificial Sequence: Synthetic peptide
YAS

SEQ ID NO: 875 - protein, 9 aa, Artificial Sequence
  Description of Artificial Sequence: Synthetic peptide
QQDYSSPPT

SEQ ID NO: 876 - protein, 118 aa, Artificial Sequence
  Description of Artificial Sequence: Synthetic polypeptide
QVQLQQSGPELVRPGVSVKISCKVSGYTFTDYVMHWVKQSHAKSLEWIGIISPYSGNTNYNQNFKGKATMTVDKSSSTAYMALARLTSEDSAIYYCAREGDLPMFAYWGQGTLVTVSA

SEQ ID NO: 877 - protein, 8 aa, Artificial Sequence
  Description of Artificial Sequence: Synthetic peptide
GYTFTDYV

SEQ ID NO: 878 - protein, 8 aa, Artificial Sequence
  Description of Artificial Sequence: Synthetic peptide
ISPYSGNT

SEQ ID NO: 879 - protein, 11 aa, Artificial Sequence
  Description of Artificial Sequence: Synthetic peptide
AREGDLPMFAY

SEQ ID NO: 880 - protein, 106 aa, Artificial Sequence
  Description of Artificial Sequence: Synthetic polypeptide
QIVLTQSPTIMSASPGEKVTMTCSASSSVSYIYWYQQNPGSSPRLLIYDTSILASGVPFRFSGSGSGTSYSLTISRMEAEDAATYYCQQWTSYPLTFGSGTKLELK

SEQ ID NO: 881 - protein, 5 aa, Artificial Sequence
  Description of Artificial Sequence: Synthetic peptide
SSVSY

SEQ ID NO: 882 - protein, 3 aa, Artificial Sequence
  Description of Artificial Sequence: Synthetic peptide
DTS

SEQ ID NO: 883 - protein, 9 aa, Artificial Sequence
  Description of Artificial Sequence: Synthetic peptide
QQWTSYPLT

SEQ ID NO: 884 - protein, 120 aa, Artificial Sequence
  Description of Artificial Sequence: Synthetic polypeptide
EVQLQQSGPELVKPGASVKISCKASGYTFTDYNINWVKQSHGKSLEWIGYIYPYIGGSGYNQKFKSKATLSADNPSSTAYMELRSLTSEDSAVYYCAREDKTARNAMDYWGQGTPVTVSS

SEQ ID NO: 885 - protein, 8 aa, Artificial Sequence
  Description of Artificial Sequence: Synthetic peptide
GYTFTDYN

SEQ ID NO: 886 - protein, 8 aa, Artificial Sequence
  Description of Artificial Sequence: Synthetic peptide
IYPYIGGS

SEQ ID NO: 887 - protein, 13 aa, Artificial Sequence
  Description of Artificial Sequence: Synthetic peptide
AREDKTARNAMDY

SEQ ID NO: 888 - protein, 107 aa, Artificial Sequence
  Description of Artificial Sequence: Synthetic polypeptide
DIQMTQSPASLSVSVGETVTIICRVSENIYSNLAWYQQKQGKSPQLLVYEATNLAEGVPSRFSGSGSGTQYSLKINSLQSEDFGSYYCQHFWGTPYTFGGGTKLEIK

SEQ ID NO: 889 - protein, 6 aa, Artificial Sequence
  Description of Artificial Sequence: Synthetic peptide
ENIYSN

SEQ ID NO: 890 - protein, 3 aa, Artificial Sequence
  Description of Artificial Sequence: Synthetic peptide
EAT

SEQ ID NO: 891 - protein, 9 aa, Artificial Sequence
  Description of Artificial Sequence: Synthetic peptide
QHFWGTPYT

SEQ ID NO: 892 - protein, 120 aa, Artificial Sequence
  Description of Artificial Sequence: Synthetic polypeptide
DVQLQESGPGLVKPSQSLSLTCTVTGYSITSDYAWNWIRQFPGNKLEWMGYISYSGSTSYNPSLKSRISITRDTSKNQFFLQLNSVTTEDTATYYCARHYRYPPYAMDYWGQGTSVTVSS

SEQ ID NO: 893 - protein, 9 aa, Artificial Sequence
  Description of Artificial Sequence: Synthetic peptide
GYSITSDYA

SEQ ID NO: 894 - protein, 7 aa, Artificial Sequence
  Description of Artificial Sequence: Synthetic peptide
ISYSGST

SEQ ID NO: 895 - protein, 13 aa, Artificial Sequence
  Description of Artificial Sequence: Synthetic peptide
ARHYRYPPYAMDY

SEQ ID NO: 896 - protein, 113 aa, Artificial Sequence
  Description of Artificial Sequence: Synthetic polypeptide
DIVMTQSPSSLAMSVGQKVTMSCKSSQSLLNSSNQKNYLAWYQQKPGQSPKLLVYFASTRESGVPDRFIGSGSGTDFTLTITSVQAEDLADYFCQQHYSTPFTFGSGTKLEIK

SEQ ID NO: 897 - protein, 12 aa, Artificial Sequence
  Description of Artificial Sequence: Synthetic peptide
QSLLNSSNQKNY

SEQ ID NO: 898 - protein, 3 aa, Artificial Sequence
  Description of Artificial Sequence: Synthetic peptide
FAS

SEQ ID NO: 899 - protein, 9 aa, Artificial Sequence
  Description of Artificial Sequence: Synthetic peptide
QQHYSTPFT

SEQ ID NO: 900 - protein, 118 aa, Artificial Sequence
  Description of Artificial Sequence: Synthetic polypeptide
QVQLKQSGPGLVQPSQSLSITCTVSGFSLTSFGVHWVRQSPGKGLEWLGVIWSGGTTVYDAAFISRLSISKDNSKSQVFFKMNSLQTNDTAIYYCARKRGNFYVMDYWGQGTSVTVSS

SEQ ID NO: 901 - protein, 8 aa, Artificial Sequence
  Description of Artificial Sequence: Synthetic peptide
GFSLTSFG

SEQ ID NO: 902 - protein, 7 aa, Artificial Sequence
  Description of Artificial Sequence: Synthetic peptide
IWSGGTT

SEQ ID NO: 903 - protein, 12 aa, Artificial Sequence
  Description of Artificial Sequence: Synthetic peptide
ARKRGNFYVMDY

SEQ ID NO: 904 - protein, 113 aa, Artificial Sequence; identical to SEQ ID NO: 896
  Description of Artificial Sequence: Synthetic polypeptide

SEQ ID NO: 905 - protein, 12 aa, Artificial Sequence
  Description of Artificial Sequence: Synthetic peptide
QSLLNSSNQKNY

SEQ ID NO: 906 - protein, 3 aa, Artificial Sequence
  Description of Artificial Sequence: Synthetic peptide
FAS

SEQ ID NO: 907 - protein, 9 aa, Artificial Sequence
  Description of Artificial Sequence: Synthetic peptide
QQHYSTPFT

SEQ ID NO: 908 - protein, 118 aa, Artificial Sequence
  Description of Artificial Sequence: Synthetic polypeptide
QVQLQQPGSELVRPGTSVKLSCKASGYTFTSYWVHWVRQRHGQGLEWIGNVYPGSGSTNYDEKFKSKGTLTVDTSSSTAYMHLSSLTSEDSAVYYCTRGVLRFPLDYWGQGTTLTVSS

SEQ ID NO: 909 - protein, 8 aa, Artificial Sequence
  Description of Artificial Sequence: Synthetic peptide
GYTFTSYW

SEQ ID NO: 910 - protein, 8 aa, Artificial Sequence
  Description of Artificial Sequence: Synthetic peptide
VYPGSGST

SEQ ID NO: 911 - protein, 11 aa, Artificial Sequence
  Description of Artificial Sequence: Synthetic peptide
TRGVLRFPLDY

SEQ ID NO: 912 - protein, 112 aa, Artificial Sequence
  Description of Artificial Sequence: Synthetic polypeptide
DIVMTQAAPSVPVTPGESVSISCRSSKSLLHSNGNTYLYWFLQRPGQSPHLLIYRMSNLASGVPDRFSGSGSGTAFTLRISRVEAEDVGVYYCMQHLEYPLTFGAGTKLELK

SEQ ID NO: 913 - protein, 11 aa, Artificial Sequence
  Description of Artificial Sequence: Synthetic peptide
KSLLHSNGNTY

SEQ ID NO: 914 - protein, 3 aa, Artificial Sequence
  Description of Artificial Sequence: Synthetic peptide
RMS

SEQ ID NO: 915 - protein, 9 aa, Artificial Sequence
  Description of Artificial Sequence: Synthetic peptide
MQHLEYPLT

SEQ ID NO: 916 - protein, 118 aa, Artificial Sequence
  Description of Artificial Sequence: Synthetic polypeptide
QVQLQQSGPEVVRPGVSVKISCKGSGYKFPDYVMHWVKQSHAKSLEWIGIISIYSGNTNYNQKFKGKATMTVDKSSSTAYMELARLTSEDSAIYYCAREGDLPMFAYWGQGTLVTVSA

SEQ ID NO: 917 - protein, 8 aa, Artificial Sequence
  Description of Artificial Sequence: Synthetic peptide
GYKFPDYV

SEQ ID NO: 918 - protein, 8 aa, Artificial Sequence
  Description of Artificial Sequence: Synthetic peptide
ISIYSGNT

SEQ ID NO: 919 - protein, 11 aa, Artificial Sequence
  Description of Artificial Sequence: Synthetic peptide
AREGDLPMFAY

SEQ ID NO: 920 - protein, 106 aa, Artificial Sequence
  Description of Artificial Sequence: Synthetic polypeptide
QIVLTQSPAIMSASPGEKVTMTCNASSSVSYMYWYQQKPISSPRLLIYDTSNLASGVPVRFSGSGSGTSYSLTIGRMEAEDAATYYCQQWSSYPLTFGAGTKVEVK

SEQ ID NO: 921 - protein, 5 aa, Artificial Sequence
  Description of Artificial Sequence: Synthetic peptide
SSVSY

SEQ ID NO: 922 - protein, 3 aa, Artificial Sequence
  Description of Artificial Sequence: Synthetic peptide
DTS

SEQ ID NO: 923 - protein, 9 aa, Artificial Sequence
  Description of Artificial Sequence: Synthetic peptide
QQWSSYPLT

SEQ ID NO: 924 - protein, 122 aa, Artificial Sequence
  Description of Artificial Sequence: Synthetic polypeptide
QVQLKESGPGLVAPSQSLSITCTVSGFSLTAYNINWVRQPPGKGLEWLGMIWGDGNTDYNSPLKSRLTISKDNSKSQVFLKMDSLQTDDTARYYCARDLKVRRDSPYTMDYWGQGTSVTVSS

SEQ ID NO: 925 - protein, 8 aa, Artificial Sequence
  Description of Artificial Sequence: Synthetic peptide
GFSLTAYN

SEQ ID NO: 926 - protein, 7 aa, Artificial Sequence
  Description of Artificial Sequence: Synthetic peptide
IWGDGNT

SEQ ID NO: 927 - protein, 16 aa, Artificial Sequence
  Description of Artificial Sequence: Synthetic peptide
ARDLKVRRDSPYTMDY

SEQ ID NO: 928 - protein, 112 aa, Artificial Sequence
  Description of Artificial Sequence: Synthetic polypeptide
NIMMTQSPSSLAVSAGEKVTMSCKSSQSVLYSSNQKNYLAWYQQKPGQSPKLLIYWASNRESGVPDRFTGSGSGTDFTLTISSVQAEDLAVYYCHQYLSSYTFGGGTKLEIK

SEQ ID NO: 929 - protein, 12 aa, Artificial Sequence
  Description of Artificial Sequence: Synthetic peptide
QSVLYSSNQKNY

SEQ ID NO: 930 - protein, 3 aa, Artificial Sequence
  Description of Artificial Sequence: Synthetic peptide
WAS

SEQ ID NO: 931 - protein, 8 aa, Artificial Sequence
  Description of Artificial Sequence: Synthetic peptide
HQYLSSYT

SEQ ID NO: 932 - protein, 124 aa, Artificial Sequence
  Description of Artificial Sequence: Synthetic polypeptide
DVQLQESGPGLVKPSQSLSLTCTVTGYSLTSDYAWNWIRQFPGNKLEWMGYITYSGGTTYNPSLKSRISITRDTSKNQFFLQLTSVTTEDTATYYCARRGSGTTVVGDWYFDVWGAGTTVTVSS

SEQ ID NO: 933 - protein, 9 aa, Artificial Sequence
  Description of Artificial Sequence: Synthetic peptide
GYSLTSDYA

SEQ ID NO: 934 - protein, 7 aa, Artificial Sequence
  Description of Artificial Sequence: Synthetic peptide
ITYSGGT

SEQ ID NO: 935 - protein, 17 aa, Artificial Sequence
  Description of Artificial Sequence: Synthetic peptide
ARRGSGTTVVGDWYFDV

SEQ ID NO: 936 - protein, 113 aa, Artificial Sequence
  Description of Artificial Sequence: Synthetic polypeptide
DIVMSQSPSSLAVSVGEKVTMSCKSSQSLLYSFNQKYYLAWYQQKPGQSPKLLIYWASTRESGVPDRFTGSGSGTDFTPTISSVTAEDLAVYYCQQFYTYPYTFGGGTKLEMK

SEQ ID NO: 937 - protein, 12 aa, Artificial Sequence
  Description of Artificial Sequence: Synthetic peptide
QSLLYSFNQKYY

SEQ ID NO: 938 - protein, 3 aa, Artificial Sequence
  Description of Artificial Sequence: Synthetic peptide
WAS

SEQ ID NO: 939 - protein, 9 aa, Artificial Sequence
  Description of Artificial Sequence: Synthetic peptide
QQFYTYPYT

SEQ ID NO: 940 - protein, 122 aa, Artificial Sequence
  Description of Artificial Sequence: Synthetic polypeptide
EVQVQQSGPELVKPGASVKISCKASGYTFTKSNMHWVKQSHGKSLEWIGYIYPYNGGTGYNQNFKSKATLTVDISSSTAYMELRSLTLEDSAVYLCAREADYYGNRGQFDYWGQGTLVTVSA

SEQ ID NO: 941 - protein, 8 aa, Artificial Sequence
  Description of Artificial Sequence: Synthetic peptide
GYTFTKSN

SEQ ID NO: 942 - protein, 8 aa, Artificial Sequence
  Description of Artificial Sequence: Synthetic peptide
IYPYNGGT

SEQ ID NO: 943 - protein, 15 aa, Artificial Sequence
  Description of Artificial Sequence: Synthetic peptide
AREADYYGNRGQFDY

SEQ ID NO: 944 - protein, 107 aa, Artificial Sequence
  Description of Artificial Sequence: Synthetic polypeptide
DIQMTQSPASLSVSVGETVTITCRASDNIFSNLAWYHQKQGKSPHLLVYGATNLADGVPSRFSGSGSGTQYSLKINSLQSEDFGDYYCQHFWGTPYTFGGGTKLEIK

SEQ ID NO: 945 - protein, 6 aa, Artificial Sequence
  Description of Artificial Sequence: Synthetic peptide
DNIFSN

SEQ ID NO: 946 - protein, 3 aa, Artificial Sequence
  Description of Artificial Sequence: Synthetic peptide
GAT

SEQ ID NO: 947 - protein, 9 aa, Artificial Sequence
  Description of Artificial Sequence: Synthetic peptide
QHFWGTPYT

SEQ ID NO: 948 - protein, 119 aa, Artificial Sequence
  Description of Artificial Sequence: Synthetic polypeptide
QVQLQQSGAELMRPGTSVKVSCKASGYAFTNHLIEWIKQRPGQGLEWIGVINPGSDSTDYNEKFKDKATLTADKSSSTAYMQLSSLTSDDSAVYFCARSLYYNSWFVYWGQGTLVTVSA

SEQ ID NO: 949 - protein, 8 aa, Artificial Sequence
  Description of Artificial Sequence: Synthetic peptide
GYAFTNHL

SEQ ID NO: 950 - protein, 8 aa, Artificial Sequence
  Description of Artificial Sequence: Synthetic peptide
INPGSDST

SEQ ID NO: 951 - protein, 12 aa, Artificial Sequence
  Description of Artificial Sequence: Synthetic peptide
ARSLYYNSWFVY

SEQ ID NO: 952 - protein, 107 aa, Artificial Sequence
  Description of Artificial Sequence: Synthetic polypeptide
DIQMTQSPASLSASVGETVTITCRASENIYSYLAWYQQKRGKSPQLLVYNAKTLVEGVPSRFSGSGSGTQFSLKINSLQPEDFGSYYCQHHYGTPYTFGGGTKLEIK

SEQ ID NO: 953 - protein, 6 aa, Artificial Sequence
  Description of Artificial Sequence: Synthetic peptide
ENIYSY

SEQ ID NO: 954 - protein, 3 aa, Artificial Sequence
  Description of Artificial Sequence: Synthetic peptide
NAK

SEQ ID NO: 955 - protein, 9 aa, Artificial Sequence
  Description of Artificial Sequence: Synthetic peptide
QHHYGTPYT

SEQ ID NO: 956 - protein, 118 aa, Artificial Sequence
  Description of Artificial Sequence: Synthetic polypeptide
EVQLQQSGAELVKPGASVRLSCTASGFSIRDTYIHWVKQRPEQGLDWIGKIDPANGKSEYDPKFQGRATMTTDTSSNTAYLQLSSLTSEDTAVYYCTRYGYYPYFDVWGAGTTVTVFS

SEQ ID NO: 957 - protein, 8 aa, Artificial Sequence
  Description of Artificial Sequence: Synthetic peptide
GFSIRDTY

SEQ ID NO: 958 - protein, 8 aa, Artificial Sequence
  Description of Artificial Sequence: Synthetic peptide
IDPANGKS

SEQ ID NO: 959 - protein, 11 aa, Artificial Sequence
  Description of Artificial Sequence: Synthetic peptide
TRYGYYPYFDV

SEQ ID NO: 960 - protein, 107 aa, Artificial Sequence
  Description of Artificial Sequence: Synthetic polypeptide
SIVMTQTPKFLLVSAGDRVAITCKASQSVRHDVVWYQQKPGQSPKLLIYYASSRYTGVPDRFTGSGYGTDFTFTISTVQAEDLALYFCLQDFSSPWTFGGGTKLEIK

SEQ ID NO: 961 - protein, 6 aa, Artificial Sequence
  Description of Artificial Sequence: Synthetic peptide
QSVRHD

SEQ ID NO: 962 - protein, 3 aa, Artificial Sequence
  Description of Artificial Sequence: Synthetic peptide
YAS

SEQ ID NO: 963 - protein, 9 aa, Artificial Sequence
  Description of Artificial Sequence: Synthetic peptide
LQDFSSPWT

SEQ ID NO: 964 - protein, 120 aa, Artificial Sequence
  Description of Artificial Sequence: Synthetic polypeptide
EVQLQQSGPELVKPGASVKISCKTSGYTFTKNTMHWVRQSHGKSLEWIGGINPNSGGASFNQKFMGKATLTVDKSSSTAYMELRSLTSEDSAVYYCARDGYDGDWFFDVWGAGTTVTVSS

SEQ ID NO: 965 - protein, 8 aa, Artificial Sequence
  Description of Artificial Sequence: Synthetic peptide
GYTFTKNT

SEQ ID NO: 966 - protein, 8 aa, Artificial Sequence
  Description of Artificial Sequence: Synthetic peptide
INPNSGGA

SEQ ID NO: 967 - protein, 13 aa, Artificial Sequence
  Description of Artificial Sequence: Synthetic peptide
ARDGYDGDWFFDV

SEQ ID NO: 968 - protein, 107 aa, Artificial Sequence
  Description of Artificial Sequence: Synthetic polypeptide
DIQMNQSPFSLSASLGDTVTITCHASQNIYVWLSWYQQKPGNIPKLLIYKASDLHTGVPSRFSGSGSGTDFTLNISSLQPEDIATYYCQQGQSYPRTFGGGTKLEIK

SEQ ID NO: 969 - protein, 6 aa, Artificial Sequence
  Description of Artificial Sequence: Synthetic peptide
QNIYVW

SEQ ID NO: 970 - protein, 3 aa, Artificial Sequence
  Description of Artificial Sequence: Synthetic peptide
KAS

SEQ ID NO: 971 - protein, 9 aa, Artificial Sequence
  Description of Artificial Sequence: Synthetic peptide
QQGQSYPRT

SEQ ID NO: 972 - protein, 114 aa, Artificial Sequence
  Description of Artificial Sequence: Synthetic polypeptide
QVQLKESGPGLVAPSQSLSITCTVSGFSLIGHGVNWIRQPPGKGLEWLGVIWGDGNTDYNSALKSRLSISKDNSKSQVFLKMNSLQTDDTARYFCAVNSAMDYWGQGTAVTVSS

SEQ ID NO: 973 - protein, 8 aa, Artificial Sequence
  Description of Artificial Sequence: Synthetic peptide
GFSLIGHG

SEQ ID NO: 974 - protein, 7 aa, Artificial Sequence
  Description of Artificial Sequence: Synthetic peptide
IWGDGNT

SEQ ID NO: 975 - protein, 8 aa, Artificial Sequence
  Description of Artificial Sequence: Synthetic peptide
AVNSAMDY

SEQ ID NO: 976 - protein, 107 aa, Artificial Sequence
  Description of Artificial Sequence: Synthetic polypeptide
NIVMTQSPKSMSMSVGERVTLNCTASENVASFVSWYQQKPEQSPKLLIYGTSNRYTGVPDRFTGSGSATDFTLTISSVQAEDLGDYHCGQSYNYPFTFGSGTKLEIE

SEQ ID NO: 977 - protein, 6 aa, Artificial Sequence
  Description of Artificial Sequence: Synthetic peptide
ENVASF

SEQ ID NO: 978 - protein, 3 aa, Artificial Sequence
  Description of Artificial Sequence: Synthetic peptide
GTS

SEQ ID NO: 979 - protein, 9 aa, Artificial Sequence
  Description of Artificial Sequence: Synthetic peptide
GQSYNYPFT

SEQ ID NO: 980 - protein, 119 aa, Artificial Sequence
  Description of Artificial Sequence: Synthetic polypeptide
QVQLQQSGAELVRPGASVKVSCKTSGYAFTNYLIEWVKQRPGQGLEWIGVINPGSGGIYYNDKFKVKTTLTADKSSSTAYMQLSSLTSDDSAVYFCARSETHDTWFAYWGQGTLVTVSA

SEQ ID NO: 981 - protein, 8 aa, Artificial Sequence
  Description of Artificial Sequence: Synthetic peptide
GYAFTNYL

SEQ ID NO: 982 - protein, 8 aa, Artificial Sequence
  Description of Artificial Sequence: Synthetic peptide
INPGSGGI

SEQ ID NO: 983 - protein, 12 aa, Artificial Sequence
  Description of Artificial Sequence: Synthetic peptide
ARSETHDTWFAY

SEQ ID NO: 984 - protein, 108 aa, Artificial Sequence
  Description of Artificial Sequence: Synthetic polypeptide
DIVMTQSQKFISTSVGDRVSITCKASQSVRIAVAWFQQKPGQSPKALIYLASTRHTGVPDRFTGSGSGTDFTLTISNVQSEDLADYFCLQHWNYPYTFGGGTKLEIKR

SEQ ID NO: 985 - protein, 6 aa, Artificial Sequence
  Description of Artificial Sequence: Synthetic peptide
QSVRIA

SEQ ID NO: 986 - protein, 3 aa, Artificial Sequence
  Description of Artificial Sequence: Synthetic peptide
LAS

SEQ ID NO: 987 - protein, 9 aa, Artificial Sequence
  Description of Artificial Sequence: Synthetic peptide
LQHWNYPYT

SEQ ID NO: 988 - protein, 120 aa, Artificial Sequence
  Description of Artificial Sequence: Synthetic polypeptide
QVQLQQSGAELVRPGTSVKMSCKAAGYTFTNYWIGWVKQRPGHGLEWIGDIYPGGGYTNYNEKFKGKATLTADTSSSTAYMQLSSLTSEDSAIYYCASPYYGSSYGFAFWGQGTLVTVSA

SEQ ID NO: 989 - protein, 8 aa, Artificial Sequence
  Description of Artificial Sequence: Synthetic peptide
GYTFTNYW

SEQ ID NO: 990 - protein, 8 aa, Artificial Sequence
  Description of Artificial Sequence: Synthetic peptide
IYPGGGYT

SEQ ID NO: 991 - protein, 13 aa, Artificial Sequence
  Description of Artificial Sequence: Synthetic peptide
ASPYYGSSYGFAF

SEQ ID NO: 992 - protein, 108 aa, Artificial Sequence; identical to SEQ ID NO: 984
  Description of Artificial Sequence: Synthetic polypeptide

SEQ ID NO: 993 - protein, 6 aa, Artificial Sequence
  Description of Artificial Sequence: Synthetic peptide
QSVRIA

SEQ ID NO: 994 - protein, 3 aa, Artificial Sequence
  Description of Artificial Sequence: Synthetic peptide
LAS

SEQ ID NO: 995 - protein, 9 aa, Artificial Sequence
  Description of Artificial Sequence: Synthetic peptide
LQHWNYPYT

SEQ ID NO: 996 - protein, 117 aa, Artificial Sequence
  Description of Artificial Sequence: Synthetic polypeptide
QVQLKESGPGLVAPSQSLSITCTVSGFSLSGYGIKWVRQPPGKGLEWLGTIWGDGSTDYNSALKSRLSISKDNSKSQVFLKMTSLQTDDTARYYCASDSLGITFGYWGQGTLVTVSA

SEQ ID NO: 997 - protein, 8 aa, Artificial Sequence
  Description of Artificial Sequence: Synthetic peptide
GFSLSGYG

SEQ ID NO: 998 - protein, 7 aa, Artificial Sequence
  Description of Artificial Sequence: Synthetic peptide
IWGDGST

SEQ ID NO: 999 - protein, 11 aa, Artificial Sequence
  Description of Artificial Sequence: Synthetic peptide
ASDSLGITFGY

SEQ ID NO: 1000 - protein, 107 aa, Artificial Sequence
  Description of Artificial Sequence: Synthetic polypeptide
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPLTFGAGTKLELK

SEQ ID NO: 1001 - protein, 6 aa, Artificial Sequence
  Description of Artificial Sequence: Synthetic peptide
QDISNY

SEQ ID NO: 1002 - protein, 3 aa, Artificial Sequence
  Description of Artificial Sequence: Synthetic peptide
YTS

SEQ ID NO: 1003 - protein, 9 aa, Artificial Sequence
  Description of Artificial Sequence: Synthetic peptide
QQGNTLPLT

SEQ ID NO: 1004 - protein, 120 aa, Artificial Sequence
  Description of Artificial Sequence: Synthetic polypeptide
QVQLKESGPGLVAPSQSLSITCTVSGFSLTSYAITWVRQPPGKGLEWLGVIWPGGGTNYNSALKSRLSISKDNSKSHLFLKMNSLQTDDTARYYCVRSYDGYLDWYFDVWGTGTTVTVSS

SEQ ID NO: 1005 - protein, 8 aa, Artificial Sequence
  Description of Artificial Sequence: Synthetic peptide
GFSLTSYA

SEQ ID NO: 1006 - protein, 7 aa, Artificial Sequence
  Description of Artificial Sequence: Synthetic peptide
IWPGGGT

SEQ ID NO: 1007 - protein, 14 aa, Artificial Sequence
  Description of Artificial Sequence: Synthetic peptide
VRSYDGYLDWYFDV

SEQ ID NO: 1008 - protein, 107 aa, Artificial Sequence
  Description of Artificial Sequence: Synthetic polypeptide
NIVMTQSPKSMSMSVGERVTLSCKASENVGTYVSWYQQKPDQSPKLLIYGASNRYTGVPDRFTGSGSATDFTLIISSVQAEDLSDYHCGQSYSYPYTFGGGTKLEII

SEQ ID NO: 1009 - protein, 6 aa, Artificial Sequence
  Description of Artificial Sequence: Synthetic peptide
ENVGTY

SEQ ID NO: 1010 - protein, 3 aa, Artificial Sequence
  Description of Artificial Sequence: Synthetic peptide
GAS

SEQ ID NO: 1011 - protein, 9 aa, Artificial Sequence
  Description of Artificial Sequence: Synthetic peptide
GQSYSYPYT

SEQ ID NO: 1012 - protein, 123 aa, Artificial Sequence
  Description of Artificial Sequence: Synthetic polypeptide
QIQLVQSGPDLKKPGETVKISCKASGYTFTTYGMSWVKQAPGRGLKWMGWINTYSGVSTFPDDFKGRFAFSLETSASTAYLQINNLKNEDSATYFCARLGMGSTTGAGYFDVWGTGTTVTVSS

SEQ ID NO: 1013 - protein, 8 aa, Artificial Sequence
  Description of Artificial Sequence: Synthetic peptide
GYTFTTYG

SEQ ID NO: 1014 - protein, 8 aa, Artificial Sequence
  Description of Artificial Sequence: Synthetic peptide
INTYSGVS

SEQ ID NO: 1015 - protein, 16 aa, Artificial Sequence
  Description of Artificial Sequence: Synthetic peptide
ARLGMGSTTGAGYFDV

SEQ ID NO: 1016 - protein, 108 aa, Artificial Sequence
  Description of Artificial Sequence: Synthetic polypeptide
DIVLTQSPAIMSASPGEKVTMTCSASSSVSSWYLHWYQQKSGASPKLWIYGTSNLASGVPARFSGSGSGTSYSLTISSVEAEDAATYYCQQYRSDPYTFGSGTKLEIK

SEQ ID NO: 1017 - protein, 7 aa, Artificial Sequence
  Description of Artificial Sequence: Synthetic peptide
SSVSSWY

SEQ ID NO: 1018 - protein, 3 aa, Artificial Sequence
  Description of Artificial Sequence: Synthetic peptide
GTS

SEQ ID NO: 1019 - protein, 9 aa, Artificial Sequence
  Description of Artificial Sequence: Synthetic peptide
QQYRSDPYT

SEQ ID NO: 1020 - protein, 123 aa, Artificial Sequence
  Description of Artificial Sequence: Synthetic polypeptide
QIQLVQSGPELKKPGETVKISCKASGYTFTTYGMSWVKQAPGKGLKWMGWINTYSGVSTYADDFEGRFAFSLETSVSTAYLQINNLKNEDTATYFCARLGRGSTTGAGYLDVWGTGTTVTVSS

SEQ ID NO: 1021 - protein, 8 aa, Artificial Sequence
  Description of Artificial Sequence: Synthetic peptide
GYTFTTYG

SEQ ID NO: 1022 - protein, 8 aa, Artificial Sequence
  Description of Artificial Sequence: Synthetic peptide
INTYSGVS

SEQ ID NO: 1023 - protein, 16 aa, Artificial Sequence
  Description of Artificial Sequence: Synthetic peptide
ARLGRGSTTGAGYLDV

SEQ ID NO: 1024 - protein, 108 aa, Artificial Sequence
  Description of Artificial Sequence: Synthetic polypeptide
DIVLTQSPAIMSASPGEKVSMTCSASSSVSSWYLHWYQQKSGASPKLWIYGTSNLASGVPARFSGSGSGTSYSLTISSVEAEDAATYYCQQYHSDPYTFGSGTKLEIK

SEQ ID NO: 1025 - protein, 7 aa, Artificial Sequence
  Description of Artificial Sequence: Synthetic peptide
SSVSSWY

SEQ ID NO: 1026 - protein, 3 aa, Artificial Sequence
  Description of Artificial Sequence: Synthetic peptide
GTS

SEQ ID NO: 1027 - protein, 9 aa, Artificial Sequence
  Description of Artificial Sequence: Synthetic peptide
QQYHSDPYT

SEQ ID NO: 1028 - protein, 123 aa, Artificial Sequence; identical to SEQ ID NO: 1012
  Description of Artificial Sequence: Synthetic polypeptide

SEQ ID NO: 1029 - protein, 8 aa, Artificial Sequence
  Description of Artificial Sequence: Synthetic peptide
GYTFTTYG

SEQ ID NO: 1030 - protein, 8 aa, Artificial Sequence
  Description of Artificial Sequence: Synthetic peptide
INTYSGVS

SEQ ID NO: 1031 - protein, 16 aa, Artificial Sequence
  Description of Artificial Sequence: Synthetic peptide
ARLGMGSTTGAGYFDV

SEQ ID NO: 1032 - protein, 106 aa, Artificial Sequence
  Description of Artificial Sequence: Synthetic polypeptide
ENVLTQSPAIMSASLGEKVTLSCRASSSVNYMYWYQQKSDASPKLWIYYTSNLAPGVPARFSGSGSGNSYSLTISSVEGEDAATYYCQQFTSSPWTFGGGTKLEIK

SEQ ID NO: 1033 - protein, 5 aa, Artificial Sequence
  Description of Artificial Sequence: Synthetic peptide
SSVNY

SEQ ID NO: 1034 - protein, 3 aa, Artificial Sequence
  Description of Artificial Sequence: Synthetic peptide
YTS

SEQ ID NO: 1035 - protein, 9 aa, Artificial Sequence
  Description of Artificial Sequence: Synthetic peptide
QQFTSSPWT

SEQ ID NO: 1036 - protein, 114 aa, Artificial Sequence
  Description of Artificial Sequence: Synthetic polypeptide
EVQLQQSGPELVKPGASVKISCKASGYTFTDYSMNWVKQSHGKSLEWIGDITPNNGSPNYNQKFKDKATLTVDKSSSTVYMELRSLTSEDSAVYYCASLFFDYWGHGTTLTVSS

SEQ ID NO: 1037 - protein, 8 aa, Artificial Sequence
  Description of Artificial Sequence: Synthetic peptide
GYTFTDYS

SEQ ID NO: 1038 - protein, 8 aa, Artificial Sequence
  Description of Artificial Sequence: Synthetic peptide
ITPNNGSP

SEQ ID NO: 1039 - protein, 7 aa, Artificial Sequence
  Description of Artificial Sequence: Synthetic peptide
ASLFFDY

SEQ ID NO: 1040 - protein, 113 aa, Artificial Sequence
  Description of Artificial Sequence: Synthetic polypeptide
DIVMTQSPSSLSVSAGEKVTMSCKSSQSLLNSGNQKNYLAWYQQKPGQPPKLLIYGASTRDSGVPDRFTGSGSGTDFTLTITSVQAEDLAVYYCQNDHTYPYTFGGGTKLEIK

SEQ ID NO: 1041 - protein, 12 aa, Artificial Sequence
  Description of Artificial Sequence: Synthetic peptide
QSLLNSGNQKNY

SEQ ID NO: 1042 - protein, 3 aa, Artificial Sequence
  Description of Artificial Sequence: Synthetic peptide
GAS

SEQ ID NO: 1043 - protein, 9 aa, Artificial Sequence
  Description of Artificial Sequence: Synthetic peptide
QNDHTYPYT

SEQ ID NO: 1044 - protein, 120 aa, Artificial Sequence
  Description of Artificial Sequence: Synthetic polypeptide
QVQLQQPGTELVKPGASVKLSCKASGFTFTTHWMHWVRQRPGQGLEWIGNIYPSNGGSNYNEKFKTKATLTVDRSSSTAYMHLSSLTSEDSAVYYCARRVNWDGYYFDYWGQGTTLTVSS

SEQ ID NO: 1045 - protein, 8 aa, Artificial Sequence
  Description of Artificial Sequence: Synthetic peptide
GFTFTTHW

SEQ ID NO: 1046 - protein, 8 aa, Artificial Sequence
  Description of Artificial Sequence: Synthetic peptide
IYPSNGGS

SEQ ID NO: 1047 - protein, 13 aa, Artificial Sequence
  Description of Artificial Sequence: Synthetic peptide
ARRVNWDGYYFDY

SEQ ID NO: 1048 - protein, 107 aa, Artificial Sequence
  Description of Artificial Sequence: Synthetic polypeptide
DIVMTQSQKFMSTSVGDRVSVTCKASQNVGTNVAWYQQKPGQSPKLLIYSASYRYSGVPDRFTGSGSGTDFTLTISNVQSEDLADYFCQQYNSYPLTFGGGTKLEIK

SEQ ID NO: 1049 - protein, 6 aa, Artificial Sequence
  Description of Artificial Sequence: Synthetic peptide
QNVGTN

SEQ ID NO: 1050 - protein, 3 aa, Artificial Sequence
  Description of Artificial Sequence: Synthetic peptide
SAS

SEQ ID NO: 1051 - protein, 9 aa, Artificial Sequence
  Description of Artificial Sequence: Synthetic peptide
QQYNSYPLT

SEQ ID NO: 1052 - protein, 118 aa, Artificial Sequence
  Description of Artificial Sequence: Synthetic polypeptide
QVQLQESGTELVKPGASVKLSCKASGYTFTSYWIHWVKQRPGQGLEWIGNINPSNGGTNYNEKFKSKAALTVDKSSSTAYMQLSSLTSEDSAVYYCARRGLPYFFDYWGQGTTLTVSS

SEQ ID NO: 1053 - protein, 8 aa, Artificial Sequence
  Description of Artificial Sequence: Synthetic peptide
GYTFTSYW

SEQ ID NO: 1054 - protein, 8 aa, Artificial Sequence
  Description of Artificial Sequence: Synthetic peptide
INPSNGGT

SEQ ID NO: 1055 - protein, 11 aa, Artificial Sequence
  Description of Artificial Sequence: Synthetic peptide
ARRGLPYFFDY

SEQ ID NO: 1056 - protein, 107 aa, Artificial Sequence
  Description of Artificial Sequence: Synthetic polypeptide
DIVMTQSQKFMSTSVGDRVSVTCKGSQNVGYNVAWYQQKPGQSPKALVYSASDRHSGVPDRFAGSGSGTDFTLTISNVQSEDLAEYFCQQYNSYPLTFGAGTKLELK

SEQ ID NO: 1057 - protein, 6 aa, Artificial Sequence
  Description of Artificial Sequence: Synthetic peptide
QNVGYN

SEQ ID NO: 1058 - protein, 3 aa, Artificial Sequence
  Description of Artificial Sequence: Synthetic peptide
SAS

SEQ ID NO: 1059 - protein, 9 aa, Artificial Sequence
  Description of Artificial Sequence: Synthetic peptide
QQYNSYPLT

SEQ ID NO: 1060 - protein, 8 aa, Artificial Sequence
  Description of Artificial Sequence: Synthetic peptide
GGTFSSYA

SEQ ID NO: 1061 - protein, 8 aa, Artificial Sequence
  Description of Artificial Sequence: Synthetic peptide
IIPIFGTA

SEQ ID NO: 1062 - protein, 13 aa, Artificial Sequence
  Description of Artificial Sequence: Synthetic peptide
AREEVSSPYGMDV

SEQ ID NO: 1063 - protein, 9 aa, Artificial Sequence
  Description of Artificial Sequence: Synthetic peptide
TGAVTSGHY

SEQ ID NO: 1064 - protein, 3 aa, Artificial Sequence
  Description of Artificial Sequence: Synthetic peptide
DTG

SEQ ID NO: 1065 - protein, 10 aa, Artificial Sequence
  Description of Artificial Sequence: Synthetic peptide
LLSYSGASWV

SEQ ID NO: 1066 - protein, 8 aa, Artificial Sequence
  Description of Artificial Sequence: Synthetic peptide
GGTFSSSA

SEQ ID NO: 1067 - protein, 8 aa, Artificial Sequence
  Description of Artificial Sequence: Synthetic peptide
IIPIYGIT

SEQ ID NO: 1068 - protein, 22 aa, Artificial Sequence
  Description of Artificial Sequence: Synthetic peptide
ARDDTARRVRGVPYYYYYAMDV

SEQ ID NO: 1069 - protein, 6 aa, Artificial Sequence
  Description of Artificial Sequence: Synthetic peptide
QGIGNY

SEQ ID NO: 1070 - protein, 3 aa, Artificial Sequence
  Description of Artificial Sequence: Synthetic peptide
SAS

SEQ ID NO: 1071 - protein, 9 aa, Artificial Sequence
  Description of Artificial Sequence: Synthetic peptide
QQLKDYPIT

SEQ ID NO: 1072 - protein, 8 aa, Artificial Sequence
  Description of Artificial Sequence: Synthetic peptide
GFSLSHFS

SEQ ID NO: 1073 - protein, 8 aa, Artificial Sequence
  Description of Artificial Sequence: Synthetic peptide
FDPEEGGT

SEQ ID NO: 1074 - protein, 14 aa, Artificial Sequence
  Description of Artificial Sequence: Synthetic peptide
ATGIWYSSGWPVDY

SEQ ID NO: 1075 - protein, 11 aa, Artificial Sequence
  Description of Artificial Sequence: Synthetic peptide
QSLLDSSGYNY

SEQ ID NO: 1076 - protein, 3 aa, Artificial Sequence
  Description of Artificial Sequence: Synthetic peptide
LGS

SEQ ID NO: 1077 - protein, 9 aa, Artificial Sequence
  Description of Artificial Sequence: Synthetic peptide
MQALQTPIT

SEQ ID NO: 1078 - protein, 8 aa, Artificial Sequence
  Description of Artificial Sequence: Synthetic peptide
GYTLTELS

SEQ ID NO: 1079 - protein, 8 aa, Artificial Sequence
  Description of Artificial Sequence: Synthetic peptide
FDPEDGET

SEQ ID NO: 1080 - protein, 18 aa, Artificial Sequence
  Description of Artificial Sequence: Synthetic peptide
ATVSRVRGVINYYYYMDV

SEQ ID NO: 1081 - protein, 11 aa, Artificial Sequence
  Description of Artificial Sequence: Synthetic peptide
QSLLYRNGNNY

SEQ ID NO: 1082 - protein, 3 aa, Artificial Sequence
  Description of Artificial Sequence: Synthetic peptide
LGS

SEQ ID NO: 1083 - protein, 9 aa, Artificial Sequence
  Description of Artificial Sequence: Synthetic peptide
MQALQTPPT

SEQ ID NO: 1084 - protein, 8 aa, Artificial Sequence
  Description of Artificial Sequence: Synthetic peptide
GGTFSSSA

SEQ ID NO: 1085 - protein, 8 aa, Artificial Sequence
  Description of Artificial Sequence: Synthetic peptide
IIPIYGIT

SEQ ID NO: 1086 - protein, 22 aa, Artificial Sequence
  Description of Artificial Sequence: Synthetic peptide
ARDDTARRVRGVPYYYYYAMDV

SEQ ID NO: 1087 - protein, 6 aa, Artificial Sequence
  Description of Artificial Sequence: Synthetic peptide
QSVDSS

SEQ ID NO: 1088 - protein, 3 aa, Artificial Sequence
  Description of Artificial Sequence: Synthetic peptide
DAS

SEQ ID NO: 1089 - protein, 9 aa, Artificial Sequence
  Description of Artificial Sequence: Synthetic peptide
QQYKDWPFT

SEQ ID NO: 1090 - protein, 8 aa, Artificial Sequence
  Description of Artificial Sequence: Synthetic peptide
GGTFGTYA

SEQ ID NO: 1091 - protein, 8 aa, Artificial Sequence
  Description of Artificial Sequence: Synthetic peptide
ITPISATI

SEQ ID NO: 1092 - protein, 13 aa, Artificial Sequence
  Description of Artificial Sequence: Synthetic peptide
ARGFEYSDGLLDD

SEQ ID NO: 1093 - protein, 12 aa, Artificial Sequence
  Description of Artificial Sequence: Synthetic peptide
QSLFYSDDGNTY

SEQ ID NO: 1094 - protein, 3 aa, Artificial Sequence
  Description of Artificial Sequence: Synthetic peptide
RLS

SEQ ID NO: 1095 - protein, 9 aa, Artificial Sequence
  Description of Artificial Sequence: Synthetic peptide
MQHMEFPLT

SEQ ID NO: 1096 - protein, 10 aa, Artificial Sequence
  Description of Artificial Sequence: Synthetic peptide
GGSISSSSYY

SEQ ID NO: 1097 - protein, 7 aa, Artificial Sequence
  Description of Artificial Sequence: Synthetic peptide
IYYSGST

SEQ ID NO: 1098 - protein, 15 aa, Artificial Sequence
  Description of Artificial Sequence: Synthetic peptide
ARGAWELRLGDWFDP

SEQ ID NO: 1099 - protein, 9 aa, Artificial Sequence
  Description of Artificial Sequence: Synthetic peptide
SSNIGAGYD

SEQ ID NO: 1100 - protein, 3 aa, Artificial Sequence
  Description of Artificial Sequence: Synthetic peptide
GNN

SEQ ID NO: 1101 - protein, 12 aa, Artificial Sequence
  Description of Artificial Sequence: Synthetic peptide
QSYDSSLSIYVV

SEQ ID NO: 1102 - protein, 9 aa, Artificial Sequence
  Description of Artificial Sequence: Synthetic peptide
SGSISSTNW

SEQ ID NO: 1103 - protein, 7 aa, Artificial Sequence
  Description of Artificial Sequence: Synthetic peptide
IYHSGST

SEQ ID NO: 1104 - protein, 10 aa, Artificial Sequence
  Description of Artificial Sequence: Synthetic peptide
ARVGPAAIYY

SEQ ID NO: 1105 - protein, 8 aa, Artificial Sequence
  Description of Artificial Sequence: Synthetic peptide
SNNVGYEG

SEQ ID NO: 1106 - protein, 3 aa, Artificial Sequence
  Description of Artificial Sequence: Synthetic peptide
RNN

SEQ ID NO: 1107 - protein, 11 aa, Artificial Sequence
  Description of Artificial Sequence: Synthetic peptide
SAWDSSLNAVV

SEQ ID NO: 1108 - protein, 8 aa, Artificial Sequence
  Description of Artificial Sequence: Synthetic peptide
GYTLTELS

SEQ ID NO: 1109 - protein, 8 aa, Artificial Sequence
  Description of Artificial Sequence: Synthetic peptide
FDPEDGET

SEQ ID NO: 1110 - protein, 21 aa, Artificial Sequence
  Description of Artificial Sequence: Synthetic peptide
ATAKPGIAVAGQNYYYYYMDV

SEQ ID NO: 1111 - protein, 11 aa, Artificial Sequence
  Description of Artificial Sequence: Synthetic peptide
QSLLYRNGNNY

SEQ ID NO: 1112 - protein, 3 aa, Artificial Sequence
  Description of Artificial Sequence: Synthetic peptide
LGS

SEQ ID NO: 1113 - protein, 9 aa, Artificial Sequence
  Description of Artificial Sequence: Synthetic peptide
MQALQTPPT

SEQ ID NO: 1114 - protein, 8 aa, Artificial Sequence
  Description of Artificial Sequence: Synthetic peptide
GFTFSSYA

SEQ ID NO: 1115 - protein, 8 aa, Artificial Sequence
  Description of Artificial Sequence: Synthetic peptide
ISYDGSNK

SEQ ID NO: 1116 - protein, 17 aa, Artificial Sequence
  Description of Artificial Sequence: Synthetic peptide
ASSPIGYSYGYWGGMDV

SEQ ID NO: 1117 - protein, 9 aa, Artificial Sequence
  Description of Artificial Sequence: Synthetic peptide
SGIDVRTNK

SEQ ID NO: 1118 - protein, 7 aa, Artificial Sequence
  Description of Artificial Sequence: Synthetic peptide
FQSDSDK

SEQ ID NO: 1119 - protein, 9 aa, Artificial Sequence
  Description of Artificial Sequence: Synthetic peptide
LIWHTSGWV

SEQ ID NO: 1120 - protein, 8 aa, Artificial Sequence
  Description of Artificial Sequence: Synthetic peptide
GYTLTELS

SEQ ID NO: 1121 - protein, 8 aa, Artificial Sequence
  Description of Artificial Sequence: Synthetic peptide
FDPEDGET

SEQ ID NO: 1122 - protein, 17 aa, Artificial Sequence
  Description of Artificial Sequence: Synthetic peptide
ATGPAAAGVGYYYYMDV

SEQ ID NO: 1123 - protein, 11 aa, Artificial Sequence
  Description of Artificial Sequence: Synthetic peptide
QSLLYRNGYNY

SEQ ID NO: 1124 - protein, 3 aa, Artificial Sequence
  Description of Artificial Sequence: Synthetic peptide
LGS

SEQ ID NO: 1125 - protein, 9 aa, Artificial Sequence
  Description of Artificial Sequence: Synthetic peptide
MQALQTPPT

SEQ ID NO: 1126 - protein, 8 aa, Artificial Sequence
  Description of Artificial Sequence: Synthetic peptide
GFTFSSYA

SEQ ID NO: 1127 - protein, 8 aa, Artificial Sequence
  Description of Artificial Sequence: Synthetic peptide
ISYDGSNK

SEQ ID NO: 1128 - protein, 20 aa, Artificial Sequence
  Description of Artificial Sequence: Synthetic peptide
ARDVMVYCSSTSCYFYGMDV

SEQ ID NO: 1129 - protein, 6 aa, Artificial Sequence
  Description of Artificial Sequence: Synthetic peptide
QDIRDY

SEQ ID NO: 1130 - protein, 3 aa, Artificial Sequence
  Description of Artificial Sequence: Synthetic peptide
DAS

SEQ ID NO: 1131 - protein, 9 aa, Artificial Sequence
  Description of Artificial Sequence: Synthetic peptide
QQFENLPIT

SEQ ID NO: 1132 - protein, 8 aa, Artificial Sequence
  Description of Artificial Sequence: Synthetic peptide
GYTLTELS

SEQ ID NO: 1133 - protein, 8 aa, Artificial Sequence
  Description of Artificial Sequence: Synthetic peptide
FDPEDGET

SEQ ID NO: 1134 - protein, 18 aa, Artificial Sequence
  Description of Artificial Sequence: Synthetic peptide
ATGGYSSGFNYYYYYMDV

SEQ ID NO: 1135 - protein, 11 aa, Artificial Sequence
  Description of Artificial Sequence: Synthetic peptide
QSLLYRNGNNY

SEQ ID NO: 1136 - protein, 3 aa, Artificial Sequence
  Description of Artificial Sequence: Synthetic peptide
LGS

SEQ ID NO: 1137 - protein, 9 aa, Artificial Sequence
  Description of Artificial Sequence: Synthetic peptide
MQALQTPPT

SEQ ID NO: 1138 - protein, 8 aa, Artificial Sequence
  Description of Artificial Sequence: Synthetic peptide
GYTLTELS

SEQ ID NO: 1139 - protein, 8 aa, Artificial Sequence
  Description of Artificial Sequence: Synthetic peptide
FDPEDGET

SEQ ID NO: 1140 - protein, 14 aa, Artificial Sequence
  Description of Artificial Sequence: Synthetic peptide
ATGVTTYYYYGMDV

SEQ ID NO: 1141 - protein, 11 aa, Artificial Sequence
  Description of Artificial Sequence: Synthetic peptide
QSLLYSNGNNF

SEQ ID NO: 1142 - protein, 3 aa, Artificial Sequence
  Description of Artificial Sequence: Synthetic peptide
LGS

SEQ ID NO: 1143 - protein, 9 aa, Artificial Sequence
  Description of Artificial Sequence: Synthetic peptide
MQALQTPPT

SEQ ID NO: 1144 - protein, 8 aa, Artificial Sequence
  Description of Artificial Sequence: Synthetic peptide
GFTFSSYG

SEQ ID NO: 1145 - protein, 8 aa, Artificial Sequence
  Description of Artificial Sequence: Synthetic peptide
IRYDGSNK

SEQ ID NO: 1146 - protein, 14 aa, Artificial Sequence
  Description of Artificial Sequence: Synthetic peptide
ARDLFDFWWDGMDV

SEQ ID NO: 1147 - protein, 7 aa, Artificial Sequence
  Description of Artificial Sequence: Synthetic peptide
QSVSSMY

SEQ ID NO: 1148 - protein, 3 aa, Artificial Sequence
  Description of Artificial Sequence: Synthetic peptide
GAS

SEQ ID NO: 1149 - protein, 10 aa, Artificial Sequence
  Description of Artificial Sequence: Synthetic peptide
QQYVSSPMYT

SEQ ID NO: 1150 - protein, 8 aa, Artificial Sequence
  Description of Artificial Sequence: Synthetic peptide
GGTFSSSA

SEQ ID NO: 1151 - protein, 8 aa, Artificial Sequence
  Description of Artificial Sequence: Synthetic peptide
IIPIYGIT

SEQ ID NO: 1152 - protein, 22 aa, Artificial Sequence
  Description of Artificial Sequence: Synthetic peptide
ARDDTARRVRGVPYYYYYAMDV

SEQ ID NO: 1153 - protein, 6 aa, Artificial Sequence
  Description of Artificial Sequence: Synthetic peptide
QSVSSY

SEQ ID NO: 1154 - protein, 3 aa, Artificial Sequence
  Description of Artificial Sequence: Synthetic peptide
DAS

SEQ ID NO: 1155 - protein, 9 aa, Artificial Sequence
  Description of Artificial Sequence: Synthetic peptide
QQYDDWPQT

SEQ ID NO: 1156 - protein, 8 aa, Artificial Sequence
  Description of Artificial Sequence: Synthetic peptide
GGTFNNYG

SEQ ID NO: 1157 - protein, 8 aa, Artificial Sequence
  Description of Artificial Sequence: Synthetic peptide
IIPLFGTT

SEQ ID NO: 1158 - protein, 15 aa, Artificial Sequence
  Description of Artificial Sequence: Synthetic peptide
ARDRMAADGMAVFDY

SEQ ID NO: 1159 - protein, 8 aa, Artificial Sequence
  Description of Artificial Sequence: Synthetic peptide
SSNIGRHF

SEQ ID NO: 1160 - protein, 3 aa, Artificial Sequence
  Description of Artificial Sequence: Synthetic peptide
KND

SEQ ID NO: 1161 - protein, 11 aa, Artificial Sequence
  Description of Artificial Sequence: Synthetic peptide
SSWDAALNGVV

SEQ ID NO: 1162 - protein, 8 aa, Artificial Sequence
  Description of Artificial Sequence: Synthetic peptide
GYTLTELS

SEQ ID NO: 1163 - protein, 8 aa, Artificial Sequence
  Description of Artificial Sequence: Synthetic peptide
FDPEDGET

SEQ ID NO: 1164 - protein, 19 aa, Artificial Sequence
  Description of Artificial Sequence: Synthetic peptide
ATEVPMVRGARRYYYYMDV

SEQ ID NO: 1165 - protein, 11 aa, Artificial Sequence
  Description of Artificial Sequence: Synthetic peptide
QTLLYINENNY

SEQ ID NO: 1166 - protein, 3 aa, Artificial Sequence
  Description of Artificial Sequence: Synthetic peptide
LGS

SEQ ID NO: 1167 - protein, 9 aa, Artificial Sequence
  Description of Artificial Sequence: Synthetic peptide
MQGLQTPPT

SEQ ID NO: 1168 - protein, 10 aa, Artificial Sequence
  Description of Artificial Sequence: Synthetic peptide
GGSISNSNYY

SEQ ID NO: 1169 - protein, 7 aa, Artificial Sequence
  Description of Artificial Sequence: Synthetic peptide
IYYSGST

SEQ ID NO: 1170 - protein, 15 aa, Artificial Sequence
  Description of Artificial Sequence: Synthetic peptide
ARGAWELSLGDWFDP

SEQ ID NO: 1171 - protein, 9 aa, Artificial Sequence
  Description of Artificial Sequence: Synthetic peptide
SSNIGAGYD

SEQ ID NO: 1172 - protein, 3 aa, Artificial Sequence
  Description of Artificial Sequence: Synthetic peptide
GNN

SEQ ID NO: 1173 - protein, 12 aa, Artificial Sequence
  Description of Artificial Sequence: Synthetic peptide
QSYDSSLSVYVV

SEQ ID NO: 1174 - protein, 8 aa, Artificial Sequence
  Description of Artificial Sequence: Synthetic peptide
GGTFSSSA

SEQ ID NO: 1175 - protein, 8 aa, Artificial Sequence
  Description of Artificial Sequence: Synthetic peptide
IIPIYGIT

SEQ ID NO: 1176 - protein, 22 aa, Artificial Sequence
  Description of Artificial Sequence: Synthetic peptide
ARDDTARRVRGVPYYYYYAMDV

SEQ ID NO: 1177 - protein, 6 aa, Artificial Sequence
  Description of Artificial Sequence: Synthetic peptide
QNVYGE

SEQ ID NO: 1178 - protein, 3 aa, Artificial Sequence
  Description of Artificial Sequence: Synthetic peptide
DTF

SEQ ID NO: 1179 - protein, 9 aa, Artificial Sequence
  Description of Artificial Sequence: Synthetic peptide
QQRRDWPIT

SEQ ID NO: 1180 - protein, 8 aa, Artificial Sequence
  Description of Artificial Sequence: Synthetic peptide
GFTFGTSS

SEQ ID NO: 1181 - protein, 8 aa, Artificial Sequence
  Description of Artificial Sequence: Synthetic peptide
ISFDGTEI

SEQ ID NO: 1182 - protein, 15 aa, Artificial Sequence
  Description of Artificial Sequence: Synthetic peptide
AKGSGNIYFYSGMDV

SEQ ID NO: 1183 - protein, 6 aa, Artificial Sequence
  Description of Artificial Sequence: Synthetic peptide
QSISGW

SEQ ID NO: 1184 - protein, 3 aa, Artificial Sequence
  Description of Artificial Sequence: Synthetic peptide
ETS

SEQ ID NO: 1185 - protein, 9 aa, Artificial Sequence
  Description of Artificial Sequence: Synthetic peptide
QQYYSYPLT

SEQ ID NO: 1186 - protein, 8 aa, Artificial Sequence
  Description of Artificial Sequence: Synthetic peptide
GYTLTELS

SEQ ID NO: 1187 - protein, 8 aa, Artificial Sequence
  Description of Artificial Sequence: Synthetic peptide
FDPEDGET

SEQ ID NO: 1188 - protein, 19 aa, Artificial Sequence
  Description of Artificial Sequence: Synthetic peptide
ATGVPAAIGVYYYYYYMDV

SEQ ID NO: 1189 - protein, 11 aa, Artificial Sequence
  Description of Artificial Sequence: Synthetic peptide
QSLLYSNGYNY

SEQ ID NO: 1190 - protein, 3 aa, Artificial Sequence
  Description of Artificial Sequence: Synthetic peptide
LGS

SEQ ID NO: 1191 - protein, 9 aa, Artificial Sequence
  Description of Artificial Sequence: Synthetic peptide
MQALQSPVT

SEQ ID NO: 1192 - protein, 8 aa, Artificial Sequence
  Description of Artificial Sequence: Synthetic peptide
GYTLTELS

SEQ ID NO: 1193 - protein, 8 aa, Artificial Sequence
  Description of Artificial Sequence: Synthetic peptide
FDPEDGET

SEQ ID NO: 1194 - protein, 20 aa, Artificial Sequence
  Description of Artificial Sequence: Synthetic peptide
ATDSRDGPAARGGYYYYMDV

SEQ ID NO: 1195 - protein, 11 aa, Artificial Sequence
  Description of Artificial Sequence: Synthetic peptide
QSLLYINGYNY

SEQ ID NO: 1196 - protein, 3 aa, Artificial Sequence
  Description of Artificial Sequence: Synthetic peptide
LGS

SEQ ID NO: 1197 - protein, 9 aa, Artificial Sequence
  Description of Artificial Sequence: Synthetic peptide
MQALQTPPT

SEQ ID NO: 1198 - protein, 8 aa, Artificial Sequence
  Description of Artificial Sequence: Synthetic peptide
GGTFSSYA

SEQ ID NO: 1199 - protein, 8 aa, Artificial Sequence
  Description of Artificial Sequence: Synthetic peptide
IIPIFGTA

SEQ ID NO: 1200 - protein, 20 aa, Artificial Sequence
  Description of Artificial Sequence: Synthetic peptide
ARDAYYYDSSGYYNPDAFDI

SEQ ID NO: 1201 - protein, 11 aa, Artificial Sequence
  Description of Artificial Sequence: Synthetic peptide
QSLLHSNGYNY

SEQ ID NO: 1202 - protein, 3 aa, Artificial Sequence
  Description of Artificial Sequence: Synthetic peptide
LGS

SEQ ID NO: 1203 - protein, 9 aa, Artificial Sequence
  Description of Artificial Sequence: Synthetic peptide
MQGLQTPRT

SEQ ID NO: 1204 - protein, 10 aa, Artificial Sequence
  Description of Artificial Sequence: Synthetic peptide
GFSLTSGGMS

SEQ ID NO: 1205 - protein, 7 aa, Artificial Sequence
  Description of Artificial Sequence: Synthetic peptide
IDWNDDK

SEQ ID NO: 1206 - protein, 12 aa, Artificial Sequence
  Description of Artificial Sequence: Synthetic peptide
ARIRGMTWGFDS

SEQ ID NO: 1207 - protein, 7 aa, Artificial Sequence
  Description of Artificial Sequence: Synthetic peptide
QSVSSSY

SEQ ID NO: 1208 - protein, 3 aa, Artificial Sequence
  Description of Artificial Sequence: Synthetic peptide
GAS

SEQ ID NO: 1209 - protein, 9 aa, Artificial Sequence
  Description of Artificial Sequence: Synthetic peptide
QQYGTTPFA

SEQ ID NO: 1210 - protein, 8 aa, Artificial Sequence
  Description of Artificial Sequence: Synthetic peptide
GYTFTAYY

SEQ ID NO: 1211 - protein, 8 aa, Artificial Sequence
  Description of Artificial Sequence: Synthetic peptide
INPNSGGT

SEQ ID NO: 1212 - protein, 21 aa, Artificial Sequence
  Description of Artificial Sequence: Synthetic peptide
ARDGAFYYGSENYYNAGWFDP

SEQ ID NO: 1213 - protein, 11 aa, Artificial Sequence
  Description of Artificial Sequence: Synthetic peptide
QSLLSGNGYNY

SEQ ID NO: 1214 - protein, 3 aa, Artificial Sequence
  Description of Artificial Sequence: Synthetic peptide
LGS

SEQ ID NO: 1215 - protein, 9 aa, Artificial Sequence
  Description of Artificial Sequence: Synthetic peptide
MQALKSPLT

SEQ ID NO: 1216 - protein, 8 aa, Artificial Sequence
  Description of Artificial Sequence: Synthetic peptide
GYTFTNYY

SEQ ID NO: 1217 - protein, 8 aa, Artificial Sequence
  Description of Artificial Sequence: Synthetic peptide
INPSGGIT

SEQ ID NO: 1218 - protein, 18 aa, Artificial Sequence
  Description of Artificial Sequence: Synthetic peptide
ARAGLGYNWNYAPSGMDV

SEQ ID NO: 1219 - protein, 9 aa, Artificial Sequence
  Description of Artificial Sequence: Synthetic peptide
SSDVGGYNY

SEQ ID NO: 1220 - protein, 3 aa, Artificial Sequence
  Description of Artificial Sequence: Synthetic peptide
EVS

SEQ ID NO: 1221 - protein, 10 aa, Artificial Sequence
  Description of Artificial Sequence: Synthetic peptide
SSYAGSNNLV

SEQ ID NO: 1222 - protein, 10 aa, Artificial Sequence
  Description of Artificial Sequence: Synthetic peptide
GGSISSSSYY

SEQ ID NO: 1223 - protein, 7 aa, Artificial Sequence
  Description of Artificial Sequence: Synthetic peptide
IYYSGST

SEQ ID NO: 1224 - protein, 15 aa, Artificial Sequence
  Description of Artificial Sequence: Synthetic peptide
ARGAWELRLGDWFDP

SEQ ID NO: 1225 - protein, 9 aa, Artificial Sequence
  Description of Artificial Sequence: Synthetic peptide
SSNIGAGYD

SEQ ID NO: 1226 - protein, 3 aa, Artificial Sequence
  Description of Artificial Sequence: Synthetic peptide
GYS

SEQ ID NO: 1227 - protein, 12 aa, Artificial Sequence
  Description of Artificial Sequence: Synthetic peptide
QSYDSSLSVYVV

SEQ ID NO: 1228 - protein, 8 aa, Artificial Sequence
  Description of Artificial Sequence: Synthetic peptide
GFTFDDYA

SEQ ID NO: 1229 - protein, 8 aa, Artificial Sequence
  Description of Artificial Sequence: Synthetic peptide
ISWNSGSI

SEQ ID NO: 1230 - protein, 15 aa, Artificial Sequence
  Description of Artificial Sequence: Synthetic peptide
AKDVNRILVAGMVDY

SEQ ID NO: 1231 - protein, 11 aa, Artificial Sequence
  Description of Artificial Sequence: Synthetic peptide
QSLLHSNGYNY

SEQ ID NO: 1232 - protein, 3 aa, Artificial Sequence
  Description of Artificial Sequence: Synthetic peptide
LGS

SEQ ID NO: 1233 - protein, 9 aa, Artificial Sequence
  Description of Artificial Sequence: Synthetic peptide
MQGLQTPIT

SEQ ID NO: 1234 - protein, 8 aa, Artificial Sequence
  Description of Artificial Sequence: Synthetic peptide
RFTFEDYA

SEQ ID NO: 1235 - protein, 8 aa, Artificial Sequence
  Description of Artificial Sequence: Synthetic peptide
ISWKSGGI

SEQ ID NO: 1236 - protein, 15 aa, Artificial Sequence
  Description of Artificial Sequence: Synthetic peptide
VKDPTLVATDRAFNI

SEQ ID NO: 1237 - protein, 11 aa, Artificial Sequence
  Description of Artificial Sequence: Synthetic peptide
QSLLHSNGYNY

SEQ ID NO: 1238 - protein, 3 aa, Artificial Sequence
  Description of Artificial Sequence: Synthetic peptide
LGS

SEQ ID NO: 1239 - protein, 9 aa, Artificial Sequence
  Description of Artificial Sequence: Synthetic peptide
MQYLQTPDT

SEQ ID NO: 1240 - protein, 8 aa, Artificial Sequence
  Description of Artificial Sequence: Synthetic peptide
GGTFSSSA

SEQ ID NO: 1241 - protein, 8 aa, Artificial Sequence
  Description of Artificial Sequence: Synthetic peptide
IIPIYGIT

SEQ ID NO: 1242 - protein, 22 aa, Artificial Sequence
  Description of Artificial Sequence: Synthetic peptide
ARDDTARRVRGVPYYYYYAMDV

SEQ ID NO: 1243 - protein, 12 aa, Artificial Sequence
  Description of Artificial Sequence: Synthetic peptide
QSLLDSDDGNIH

SEQ ID NO: 1244 - protein, 3 aa, Artificial Sequence
  Description of Artificial Sequence: Synthetic peptide
TLS

SEQ ID NO: 1245 - protein, 9 aa, Artificial Sequence
  Description of Artificial Sequence: Synthetic peptide
MQRKEFPLT

SEQ ID NO: 1246 - protein, 8 aa, Artificial Sequence
  Description of Artificial Sequence: Synthetic peptide
GFTFSSYG

SEQ ID NO: 1247 - protein, 8 aa, Artificial Sequence
  Description of Artificial Sequence: Synthetic peptide
ISYDGSNK

SEQ ID NO: 1248 - protein, 18 aa, Artificial Sequence
  Description of Artificial Sequence: Synthetic peptide
AKEDRLRFLEWLFYGMDV

SEQ ID NO: 1249 - protein, 6 aa, Artificial Sequence
  Description of Artificial Sequence: Synthetic peptide
HDIYTY

SEQ ID NO: 1250 - protein, 3 aa, Artificial Sequence
  Description of Artificial Sequence: Synthetic peptide
DAS

SEQ ID NO: 1251 - protein, 11 aa, Artificial Sequence
  Description of Artificial Sequence: Synthetic peptide
QQYDNHPPEVT

SEQ ID NO: 1252 - protein, 8 aa, Artificial Sequence
  Description of Artificial Sequence: Synthetic peptide
GGTFSSSA

SEQ ID NO: 1253 - protein, 8 aa, Artificial Sequence
  Description of Artificial Sequence: Synthetic peptide
IIPIYGIT

SEQ ID NO: 1254 - protein, 22 aa, Artificial Sequence
  Description of Artificial Sequence: Synthetic peptide
ARDDTARRVRGVPYYYYYAMDV

SEQ ID NO: 1255 - protein, 6 aa, Artificial Sequence
  Description of Artificial Sequence: Synthetic peptide
QDIDDD

SEQ ID NO: 1256 - protein, 3 aa, Artificial Sequence
  Description of Artificial Sequence: Synthetic peptide
EAS

SEQ ID NO: 1257 - protein, 9 aa, Artificial Sequence
  Description of Artificial Sequence: Synthetic peptide
LQHDNLPLT

SEQ ID NO: 1258 - protein, 8 aa, Artificial Sequence
  Description of Artificial Sequence: Synthetic peptide
GYTLTELS

SEQ ID NO: 1259 - protein, 8 aa, Artificial Sequence
  Description of Artificial Sequence: Synthetic peptide
FDPEDGET

SEQ ID NO: 1260 - protein, 19 aa, Artificial Sequence
  Description of Artificial Sequence: Synthetic peptide
ATEDPGPVAGPYYYYGMDV

SEQ ID NO: 1261 - protein, 11 aa, Artificial Sequence
  Description of Artificial Sequence: Synthetic peptide
QSLLYINGYHY

SEQ ID NO: 1262 - protein, 3 aa, Artificial Sequence
  Description of Artificial Sequence: Synthetic peptide
LGS

SEQ ID NO: 1263 - protein, 9 aa, Artificial Sequence
  Description of Artificial Sequence: Synthetic peptide
MQALQTPPT

SEQ ID NO: 1264 - protein, 8 aa, Artificial Sequence
  Description of Artificial Sequence: Synthetic peptide
GYMFTNYP

SEQ ID NO: 1265 - protein, 8 aa, Artificial Sequence
  Description of Artificial Sequence: Synthetic peptide
INAGTGNT

SEQ ID NO: 1266 - protein, 21 aa, Artificial Sequence
  Description of Artificial Sequence: Synthetic peptide
AREGMFYYGLESYYKGGWFDP

SEQ ID NO: 1267 - protein, 11 aa, Artificial Sequence
  Description of Artificial Sequence: Synthetic peptide
QSLLHRNGYNY

SEQ ID NO: 1268 - protein, 3 aa, Artificial Sequence
  Description of Artificial Sequence: Synthetic peptide
LAS

SEQ ID NO: 1269 - protein, 9 aa, Artificial Sequence
  Description of Artificial Sequence: Synthetic peptide
MQALQTPLT

SEQ ID NO: 1270 - protein, 8 aa, Artificial Sequence
  Description of Artificial Sequence: Synthetic peptide
GGTFSSSA

SEQ ID NO: 1271 - protein, 8 aa, Artificial Sequence
  Description of Artificial Sequence: Synthetic peptide
IIPIYGIT

SEQ ID NO: 1272 - protein, 22 aa, Artificial Sequence
  Description of Artificial Sequence: Synthetic peptide
ARDDTARRVRGVPYYYYYAMDV

SEQ ID NO: 1273 - protein, 12 aa, Artificial Sequence
  Description of Artificial Sequence: Synthetic peptide
QSLLDSDDGNTY

SEQ ID NO: 1274 - protein, 3 aa, Artificial Sequence
  Description of Artificial Sequence: Synthetic peptide
TLS

SEQ ID NO: 1275 - protein, 9 aa, Artificial Sequence
  Description of Artificial Sequence: Synthetic peptide
MQRLQFPLT

SEQ ID NO: 1276 - protein, 8 aa, Artificial Sequence
  Description of Artificial Sequence: Synthetic peptide
TYTFTTYY

SEQ ID NO: 1277 - protein, 8 aa, Artificial Sequence
  Description of Artificial Sequence: Synthetic peptide
IYPSGGNT

SEQ ID NO: 1278 - protein, 13 aa, Artificial Sequence
  Description of Artificial Sequence: Synthetic peptide
VRDQNYYYSAMDV

SEQ ID NO: 1279 - protein, 6 aa, Artificial Sequence
  Description of Artificial Sequence: Synthetic peptide
QDIRNY

SEQ ID NO: 1280 - protein, 3 aa, Artificial Sequence
  Description of Artificial Sequence: Synthetic peptide
DAS

SEQ ID NO: 1281 - protein, 9 aa, Artificial Sequence
  Description of Artificial Sequence: Synthetic peptide
QQFENLPIT

SEQ ID NO: 1282 - protein, 8 aa, Artificial Sequence
  Description of Artificial Sequence: Synthetic peptide
GGTFSSSA

SEQ ID NO: 1283 - protein, 8 aa, Artificial Sequence
  Description of Artificial Sequence: Synthetic peptide
IIPIYGIT

SEQ ID NO: 1284 - protein, 22 aa, Artificial Sequence
  Description of Artificial Sequence: Synthetic peptide
ARDDTARRVRGVPYYYYYAMDV

SEQ ID NO: 1285 - protein, 6 aa, Artificial Sequence
  Description of Artificial Sequence: Synthetic peptide
RDISDS

SEQ ID NO: 1286 - protein, 3 aa, Artificial Sequence
  Description of Artificial Sequence: Synthetic peptide
DAS

SEQ ID NO: 1287 - protein, 9 aa, Artificial Sequence
  Description of Artificial Sequence: Synthetic peptide
HQYDNLPLT

SEQ ID NO: 1288 - protein, 8 aa, Artificial Sequence
  Description of Artificial Sequence: Synthetic peptide
GFNFRGYA

SEQ ID NO: 1289 - protein, 8 aa, Artificial Sequence
  Description of Artificial Sequence: Synthetic peptide
ISGSGGTT

SEQ ID NO: 1290 - protein, 15 aa, Artificial Sequence
  Description of Artificial Sequence: Synthetic peptide
AQSYAQIGYGGHIDH

SEQ ID NO: 1291 - protein, 9 aa, Artificial Sequence
  Description of Artificial Sequence: Synthetic peptide
SGIDVATYM

SEQ ID NO: 1292 - protein, 7 aa, Artificial Sequence
  Description of Artificial Sequence: Synthetic peptide
YKSDSDK

SEQ ID NO: 1293 - protein, 9 aa, Artificial Sequence
  Description of Artificial Sequence: Synthetic peptide
LIWHGSHYV

SEQ ID NO: 1294 - protein, 8 aa, Artificial Sequence
  Description of Artificial Sequence: Synthetic peptide
GYTLTELS

SEQ ID NO: 1295 - protein, 8 aa, Artificial Sequence
  Description of Artificial Sequence: Synthetic peptide
FDPEDGET

SEQ ID NO: 1296 - protein, 19 aa, Artificial Sequence
  Description of Artificial Sequence: Synthetic peptide
ATGVPAAIGVYYYYYYMDV

SEQ ID NO: 1297 - protein, 11 aa, Artificial Sequence
  Description of Artificial Sequence: Synthetic peptide
QSLLYRNGYNY

SEQ ID NO: 1298 - protein, 3 aa, Artificial Sequence
  Description of Artificial Sequence: Synthetic peptide
WGS

SEQ ID NO: 1299 - protein, 9 aa, Artificial Sequence
  Description of Artificial Sequence: Synthetic peptide
MQAVQNPPT

SEQ ID NO: 1300 - protein, 8 aa, Artificial Sequence
  Description of Artificial Sequence: Synthetic peptide
GGTFSSSA

SEQ ID NO: 1301 - protein, 8 aa, Artificial Sequence
  Description of Artificial Sequence: Synthetic peptide
IIPIYGIT

SEQ ID NO: 1302 - protein, 22 aa, Artificial Sequence
  Description of Artificial Sequence: Synthetic peptide
ARDDTARRVRGVPYYYYYAMDV

SEQ ID NO: 1303 - protein, 6 aa, Artificial Sequence
  Description of Artificial Sequence: Synthetic peptide
QNIDSS

SEQ ID NO: 1304 - protein, 3 aa, Artificial Sequence
  Description of Artificial Sequence: Synthetic peptide
YAS

SEQ ID NO: 1305 - protein, 9 aa, Artificial Sequence
  Description of Artificial Sequence: Synthetic peptide
HQSSSLPLT

SEQ ID NO: 1306 - protein, 8 aa, Artificial Sequence
  Description of Artificial Sequence: Synthetic peptide
GGTFSSSA

SEQ ID NO: 1307 - protein, 8 aa, Artificial Sequence
  Description of Artificial Sequence: Synthetic peptide
IIPIYGIT

SEQ ID NO: 1308 - protein, 22 aa, Artificial Sequence
  Description of Artificial Sequence: Synthetic peptide
ARDDTARRVRGVPYYYYYAMDV

SEQ ID NO: 1309 - protein, 7 aa, Artificial Sequence
  Description of Artificial Sequence: Synthetic peptide
QSVYNNY

SEQ ID NO: 1310 - protein, 3 aa, Artificial Sequence
  Description of Artificial Sequence: Synthetic peptide
DAS

SEQ ID NO: 1311 - protein, 10 aa, Artificial Sequence
  Description of Artificial Sequence: Synthetic peptide
QQYNSWPPYT

SEQ ID NO: 1312 - protein, 8 aa, Artificial Sequence
  Description of Artificial Sequence: Synthetic peptide
GGTFSSYA

SEQ ID NO: 1313 - protein, 8 aa, Artificial Sequence
  Description of Artificial Sequence: Synthetic peptide
IIPIFGTA

SEQ ID NO: 1314 - protein, 20 aa, Artificial Sequence
  Description of Artificial Sequence: Synthetic peptide
ARDAYYYDSSGYYNPDAFDI

SEQ ID NO: 1315 - protein, 11 aa, Artificial Sequence
  Description of Artificial Sequence: Synthetic peptide
QSLLYSNGYNY

SEQ ID NO: 1316 - protein, 3 aa, Artificial Sequence
  Description of Artificial Sequence: Synthetic peptide
LGS

SEQ ID NO: 1317 - protein, 9 aa, Artificial Sequence
  Description of Artificial Sequence: Synthetic peptide
MQARQTPYT

SEQ ID NO: 1318 - protein, 8 aa, Artificial Sequence
  Description of Artificial Sequence: Synthetic peptide
GGTFSSSA

SEQ ID NO: 1319 - protein, 8 aa, Artificial Sequence
  Description of Artificial Sequence: Synthetic peptide
IIPIYGIT

SEQ ID NO: 1320 - protein, 22 aa, Artificial Sequence
  Description of Artificial Sequence: Synthetic peptide
ARDDTARRVRGVPYYYYYAMDV

SEQ ID NO: 1321 - protein, 6 aa, Artificial Sequence
  Description of Artificial Sequence: Synthetic peptide
ESVTTF

SEQ ID NO: 1322 - protein, 3 aa, Artificial Sequence
  Description of Artificial Sequence: Synthetic peptide
DAS

SEQ ID NO: 1323 - protein, 9 aa, Artificial Sequence
  Description of Artificial Sequence: Synthetic peptide
HQHTNWPLT

SEQ ID NO: 1324 - protein, 8 aa, Artificial Sequence
  Description of Artificial Sequence: Synthetic peptide
GYTLTELS

SEQ ID NO: 1325 - protein, 8 aa, Artificial Sequence
  Description of Artificial Sequence: Synthetic peptide
FDPEDGET

SEQ ID NO: 1326 - protein, 22 aa, Artificial Sequence
  Description of Artificial Sequence: Synthetic peptide
ATEVGYCSGGSCYISYYYGMDV

SEQ ID NO: 1327 - protein, 11 aa, Artificial Sequence
  Description of Artificial Sequence: Synthetic peptide
QSLLYRNGHNF

SEQ ID NO: 1328 - protein, 3 aa, Artificial Sequence
  Description of Artificial Sequence: Synthetic peptide
LGS

SEQ ID NO: 1329 - protein, 9 aa, Artificial Sequence
  Description of Artificial Sequence: Synthetic peptide
MQALQTPPT

SEQ ID NO: 1330 - protein, 8 aa, Artificial Sequence
  Description of Artificial Sequence: Synthetic peptide
GGTFSSSA

SEQ ID NO: 1331 - protein, 8 aa, Artificial Sequence
  Description of Artificial Sequence: Synthetic peptide
IIPIYGIT

SEQ ID NO: 1332 - protein, 22 aa, Artificial Sequence
  Description of Artificial Sequence: Synthetic peptide
ARDDTARRVRGVPYYYYYAMDV

SEQ ID NO: 1333 - protein, 6 aa, Artificial Sequence
  Description of Artificial Sequence: Synthetic peptide
QTMNNY

SEQ ID NO: 1334 - protein, 3 aa, Artificial Sequence
  Description of Artificial Sequence: Synthetic peptide
DAS

SEQ ID NO: 1335 - protein, 10 aa, Artificial Sequence
  Description of Artificial Sequence: Synthetic peptide
QQYGDWLPIT

SEQ ID NO: 1336 - protein, 8 aa, Artificial Sequence
  Description of Artificial Sequence: Synthetic peptide
GYTLTELS

SEQ ID NO: 1337 - protein, 8 aa, Artificial Sequence
  Description of Artificial Sequence: Synthetic peptide
FDPEDGET

SEQ ID NO: 1338 - protein, 17 aa, Artificial Sequence
  Description of Artificial Sequence: Synthetic peptide
ATAFPEATISYYYYMDV

SEQ ID NO: 1339 - protein, 11 aa, Artificial Sequence
  Description of Artificial Sequence: Synthetic peptide
QSLLYRNGYNY

SEQ ID NO: 1340 - protein, 3 aa, Artificial Sequence
  Description of Artificial Sequence: Synthetic peptide
WGS

SEQ ID NO: 1341 - protein, 9 aa, Artificial Sequence
  Description of Artificial Sequence: Synthetic peptide
MQAVQNPPT

SEQ ID NO: 1342 - protein, 8 aa, Artificial Sequence
  Description of Artificial Sequence: Synthetic peptide
GGTFSSSA

SEQ ID NO: 1343 - protein, 8 aa, Artificial Sequence
  Description of Artificial Sequence: Synthetic peptide
IIPIYGIT

SEQ ID NO: 1344 - protein, 22 aa, Artificial Sequence
  Description of Artificial Sequence: Synthetic peptide
ARDDTARRVRGVPYYYYYAMDV

SEQ ID NO: 1345 - protein, 12 aa, Artificial Sequence
  Description of Artificial Sequence: Synthetic peptide
RSLLDSDDGNTH

SEQ ID NO: 1346 - protein, 3 aa, Artificial Sequence
  Description of Artificial Sequence: Synthetic peptide
SLS

SEQ ID NO: 1347 - protein, 9 aa, Artificial Sequence
  Description of Artificial Sequence: Synthetic peptide
MQRKEFPLT

SEQ ID NO: 1348 - protein, 8 aa, Artificial Sequence
  Description of Artificial Sequence: Synthetic peptide
GGTFSSYA

SEQ ID NO: 1349 - protein, 8 aa, Artificial Sequence
  Description of Artificial Sequence: Synthetic peptide
IIPIFGTA

SEQ ID NO: 1350 - protein, 21 aa, Artificial Sequence
  Description of Artificial Sequence: Synthetic peptide
ARGPWYYDSSGYSSYAYYMDV

SEQ ID NO: 1351 - protein, 11 aa, Artificial Sequence
  Description of Artificial Sequence: Synthetic peptide
QSLLHSDGYNY

SEQ ID NO: 1352 - protein, 3 aa, Artificial Sequence
  Description of Artificial Sequence: Synthetic peptide
LGS

SEQ ID NO: 1353 - protein, 10 aa, Artificial Sequence
  Description of Artificial Sequence: Synthetic peptide
MQALHTPGVT

SEQ ID NO: 1354 - protein, 330 aa, Homo sapiens [sequence omitted]

SEQ ID NO: 1355 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1356 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 1357 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1358 - protein, 21 aa, Homo sapiens
TTLAVLHPERGIRQWAPARQA

SEQ ID NO: 1359 - protein, 34 aa, Homo sapiens
TTLAVLHPERGIRQWAPARQARWETQSSISLILE

SEQ ID NO: 1360 - protein, 17 aa, Homo sapiens
ARQARWETQSSISLILE

SEQ ID NO: 1361 - protein, 16 aa, Homo sapiens
TFCCKFASFPEGSWEA

SEQ ID NO: 1362 - protein, 24 aa, Homo sapiens
TFCCKFASFPEGSWEACGSLPPSS

SEQ ID NO: 1363 - protein, 15 aa, Homo sapiens
EATELSSFTIRCGFL

SEQ ID NO: 1364 - protein, 22 aa, Homo sapiens
EVWVQVRMEATELSSFTIRCGF

SEQ ID NO: 1365 - protein, 19 aa, Homo sapiens
FTIRCGFLGSGSISLVTVS

SEQ ID NO: 1366 - protein, 24 aa, Homo sapiens
SISLVTVSWGGPNGAGGTTLAVLH

SEQ ID NO: 1367 - protein, 26 aa, Homo sapiens
SISLILEGSGASSPCANTTFCCKFAS

SEQ ID NO: 1368 - protein, 98 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 1369 - protein, 15 aa, Artificial Sequence
  Description of Artificial Sequence: Synthetic peptide
YFDYWGQGTLVTVSS

SEQ ID NO: 1370 - protein, 120 aa, Artificial Sequence
  Description of Artificial Sequence: Synthetic polypeptide
  MOD_RES (33)..(33): Asn, Gln, Ser or Ala
  MOD_RES (105)..(105): Asn, Gln, Ser or Ala
EVQLQQSGPELVKPGASVKISCKASGYTFTDYXINWVKQSHGKSLEWIGYIYPYIGGSGYNQKFKSKATLSADNPSSTAYMELRSLTSEDSAVYYCAREDKTARXAMDYWGQGTPVTVSS

SEQ ID NO: 1371 - protein, 98 aa, Artificial Sequence
  Description of Artificial Sequence: Synthetic polypeptide
  MOD_RES (33)..(33): Tyr, Gln, Ser or Ala
QVQLVQSGAEVKKPGASVKVSCKASGYTFTSYXMHWVRQAPGQGLEWMGIINPSGGSTSYAQKFQGRVTMTRDTSTSTVYMELSSLRSEDTAVYYCAR

SEQ ID NO: 1372 - protein, 120 aa, Artificial Sequence
  Description of Artificial Sequence: Synthetic polypeptide
  MOD_RES (33)..(33): Asn, Gln, Ser or Ala
  MOD_RES (105)..(105): Asn, Gln, Ser or Ala
QVQLVQSGAEVKKPGASVKVSCKASGYTFTDYXINWVRQAPGQGLEWMGYIYPYIGGSGYAQKFQGRVTMTRDTSTSTVYMELSSLRSEDTAVYYCAREDKTARXAMDYWGQGTLVTVSS

SEQ ID NO: 1373 - protein, 120 aa, Artificial Sequence
  Description of Artificial Sequence: Synthetic polypeptide
  MOD_RES (33)..(33): Asn, Gln, Ser or Ala
  MOD_RES (105)..(105): Asn, Gln, Ser or Ala
QVQLVQSGAEVKKPGASVKVSCKASGYTFTDYXINWVRQAPGQGLEWIGYIYPYIGGSGYAQKFQGRVTMTADTSTSTVYMELSSLRSEDTAVYYCAREDKTARXAMDYWGQGTLVTVSS

SEQ ID NO: 1374 - protein, 120 aa, Artificial Sequence
  Description of Artificial Sequence: Synthetic polypeptide
  MOD_RES (33)..(33): Asn, Gln, Ser or Ala
  MOD_RES (105)..(105): Asn, Gln, Ser or Ala
QVQLVQSGAEVKKPGASVKISCKASGYTFTDYXINWVRQAPGQGLEWIGYIYPYIGGSGYAQKFQGRATLTADTSTSTAYMELSSLRSEDTAVYYCAREDKTARXAMDYWGQGTLVTVSS

SEQ ID NO: 1375 - protein, 120 aa, Artificial Sequence
  Description of Artificial Sequence: Synthetic polypeptide
  MOD_RES (33)..(33): Asn, Gln, Ser or Ala
  MOD_RES (105)..(105): Asn, Gln, Ser or Ala
QVQLVQSGAEVKKPGASVKISCKASGYTFTDYXINWVRQAPGQGLEWIGYIYPYIGGSGYAQKFQGRATLTADNSTSTAYMELSSLRSEDTAVYYCAREDKTARXAMDYWGQGTLVTVSS

SEQ ID NO: 1376 - protein, 96 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP

SEQ ID NO: 1377 - protein, 12 aa, Artificial Sequence
  Description of Artificial Sequence: Synthetic peptide
YTFGQGTKLEIK

SEQ ID NO: 1378 - protein, 107 aa, Artificial Sequence
  Description of Artificial Sequence: Synthetic polypeptide
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPASLSVSVGETVTIICRVSEXIYSXLAWYQQKQGKSPQLLVYEATXLAEGVPSRFSGSGSGTQYSLKINSLQSEDFGSYYCQHFXGTPYTFGGGTKLEIK

SEQ ID NO: 1379 - protein, 96 aa, Artificial Sequence
  Description of Artificial Sequence: Synthetic polypeptide
  MOD_RES (28)..(28): Gln, Ser, Ala or Asp
  MOD_RES (32)..(32): Tyr, Gln, Ser, Ala or Asp
  MOD_RES (53)..(53): Gln, Ser, Ala or Asp
  MOD_RES (92)..(92): Tyr, Phe or His
DIQMTQSPSSLSASVGDRVTITCRASQXISSXLNWYQQKPGKAPKLLIYAASXLQSGVPSRFSGSGSGTDFTLTISSLQPEDFATYYCQQSXSTPP

SEQ ID NO: 1380 - protein, 107 aa, Artificial Sequence
  Description of Artificial Sequence: Synthetic polypeptide
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPSSLSASVGDRVTITCRVSEXIYSXLAWYQQKPGKAPKLLIYEATXLAEGVPSRFSGSGSGTDFTLTISSLQPEDFATYYCQHFXGTPYTFGQGTKLEIK

SEQ ID NO: 1381 - protein, 107 aa, Artificial Sequence
  Description of Artificial Sequence: Synthetic polypeptide
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPSSLSASVGDRVTITCRVSEXIYSXLAWYQQKPGKAPKLLIYEATXLAEGVPSRFSGSGSGTDYTLTISSLQPEDFATYYCQHFXGTPYTFGQGTKLEIK

SEQ ID NO: 1382 - protein, 107 aa, Artificial Sequence
  Description of Artificial Sequence: Synthetic polypeptide
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPSSLSASVGDRVTITCRVSEXIYSXLAWYQQKPGKAPKLLVYEATXLAEGVPSRFSGSGSGTDYTLTISSLQPEDFGTYYCQHFXGTPYTFGQGTKLEIK

SEQ ID NO: 1383 - protein, 98 aa, Artificial Sequence; identical to SEQ ID NO: 1368
  Description of Artificial Sequence: Synthetic polypeptide

SEQ ID NO: 1384 - protein, 15 aa, Artificial Sequence
  Description of Artificial Sequence: Synthetic peptide
YFDYWGQGTLVTVSS

SEQ ID NO: 1385 - protein, 118 aa, Artificial Sequence
  Description of Artificial Sequence: Synthetic polypeptide
  MOD_RES (57)..(57): Asn, Gln, Ser or Ala
  MOD_RES (59)..(59): Asn, Gln, Ser or Ala
  MOD_RES (104)..(104): Met, Leu, Phe or Ala
QVQLQQSGPEVVRPGVSVKISCKGSGYKFPDYVMHWVKQSHAKSLEWIGIISIYSGXTXYNQKFKGKATMTVDKSSSTAYMELARLTSEDSAIYYCAREGDLPXFAYWGQGTLVTVSA

SEQ ID NO: 1386 - protein, 98 aa, Artificial Sequence
  Description of Artificial Sequence: Synthetic polypeptide
  MOD_RES (57)..(57): Gln, Ser or Ala
  MOD_RES (59)..(59): Gln, Ser or Ala
QVQLVQSGAEVKKPGASVKVSCKASGYTFTSYYMHWVRQAPGQGLEWMGIINPSGGXTXYAQKFQGRVTMTRDTSTSTVYMELSSLRSEDTAVYYCAR

SEQ ID NO: 1387 - protein, 118 aa, Artificial Sequence
  Description of Artificial Sequence: Synthetic polypeptide
  MOD_RES (57)..(57): Asn, Gln, Ser or Ala
  MOD_RES (59)..(59): Asn, Gln, Ser or Ala
  MOD_RES (104)..(104): Met, Leu, Phe or Ala
QVQLVQSGAEVKKPGASVKVSCKASGYKFPDYVMHWVRQAPGQGLEWMGIISIYSGXTXYAQKFQGRVTMTRDTSTSTVYMELSSLRSEDTAVYYCAREGDLPXFAYWGQGTLVTVSS

SEQ ID NO: 1388 - protein, 118 aa, Artificial Sequence
  Description of Artificial Sequence: Synthetic polypeptide
  MOD_RES (57)..(57): Asn, Gln, Ser or Ala
  MOD_RES (59)..(59): Asn, Gln, Ser or Ala
  MOD_RES (104)..(104): Met, Leu, Phe or Ala
QVQLVQSGAEVKKPGASVKVSCKASGYKFPDYVMHWVRQAPGQGLEWIGIISIYSGXTXYAQKFQGRVTMTVDTSTSTVYMELSSLRSEDTAVYYCAREGDLPXFAYWGQGTLVTVSS

SEQ ID NO: 1389 - protein, 118 aa, Artificial Sequence
  Description of Artificial Sequence: Synthetic polypeptide
  MOD_RES (57)..(57): Asn, Gln, Ser or Ala
  MOD_RES (59)..(59): Asn, Gln, Ser or Ala
  MOD_RES (104)..(104): Met, Leu, Phe or Ala
QVQLVQSGAEVKKPGASVKISCKGSGYKFPDYVMHWVRQAPGQGLEWIGIISIYSGXTXYAQKFQGRATMTVDTSTSTAYMELSSLRSEDTAVYYCAREGDLPXFAYWGQGTLVTVSS

SEQ ID NO: 1390 - protein, 118 aa, Artificial Sequence
  Description of Artificial Sequence: Synthetic polypeptide
  MOD_RES (57)..(57): Asn, Gln, Ser or Ala
  MOD_RES (59)..(59): Asn, Gln, Ser or Ala
  MOD_RES (104)..(104): Met, Leu, Phe or Ala
QVQLVQSGAEVKKPGASVKISCKGSGYKFPDYVMHWVRQAPGQGLEWIGIISIYSGXTXYAQKFQGRATMTVDKSTSTAYMELSSLRSEDTAVYYCAREGDLPXFAYWGQGTLVTVSS

SEQ ID NO: 1391 - protein, 96 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPP

SEQ ID NO: 1392 - protein, 12 aa, Artificial Sequence
  Description of Artificial Sequence: Synthetic peptide
YTFGQGTKLEIK

SEQ ID NO: 1393 - protein, 106 aa, Artificial Sequence
  Description of Artificial Sequence: Synthetic polypeptide
  MOD_RES (24)..(24): Asn, Gln, Ser, Ala or Asp
  MOD_RES (52)..(52): Asn, Gln, Ser, Ala or Asp
  MOD_RES (90)..(90): Trp, Tyr, Phe or His
QIVLTQSPAIMSASPGEKVTMTCXASSSVSYMYWYQQKPISSPRLLIYDTSXLASGVPVRFSGSGSGTSYSLTIGRMEAEDAATYYCQQXSSYPLTFGAGTKVEVK

SEQ ID NO: 1394 - protein, 96 aa, Artificial Sequence
  Description of Artificial Sequence: Synthetic polypeptide
  MOD_RES (24)..(24): Arg, Gln, Ser, Ala or Asp
  MOD_RES (53)..(53): Asn, Gln, Ser, Ala or Asp
  MOD_RES (91)..(91): Arg, Tyr, Phe or His
EIVLTQSPATLSLSPGERATLSCXASQSVSSYLAWYQQKPGQAPRLLIYDASXRATGIPARFSGSGSGTDFTLTISSLEPEDFAVYYCQQXSNWPP

SEQ ID NO: 1395 - protein, 106 aa, Artificial Sequence
  Description of Artificial Sequence: Synthetic polypeptide
  MOD_RES (24)..(24): Asn, Gln, Ser, Ala or Asp
  MOD_RES (52)..(52): Asn, Gln, Ser, Ala or Asp
  MOD_RES (90)..(90): Trp, Tyr, Phe or His
EIVLTQSPATLSLSPGERATLSCXASSSVSYMYWYQQKPGQAPRLLIYDTSXLASGIPARFSGSGSGTDFTLTISSLEPEDFAVYYCQQXSSYPLTFGQGTKLEIK

SEQ ID NO: 1396 - protein, 106 aa, Artificial Sequence
  Description of Artificial Sequence: Synthetic polypeptide
  MOD_RES (24)..(24): Asn, Gln, Ser, Ala or Asp
  MOD_RES (52)..(52): Asn, Gln, Ser, Ala or Asp
  MOD_RES (90)..(90): Trp, Tyr, Phe or His
EIVLTQSPATLSLSPGERATLSCXASSSVSYMYWYQQKPGQAPRLLIYDTSXLASGIPARFSGSGSGTDYTLTISSLEPEDFAVYYCQQXSSYPLTFGQGTKLEIK

SEQ ID NO: 1397 - protein, 106 aa, Artificial Sequence
  Description of Artificial Sequence: Synthetic polypeptide
  MOD_RES (24)..(24): Asn, Gln, Ser, Ala or Asp
  MOD_RES (52)..(52): Asn, Gln, Ser, Ala or Asp
  MOD_RES (90)..(90): Trp, Tyr, Phe or His
EIVLTQSPATLSLSPGERVTMSCXASSSVSYMYWYQQKPGQAPRLLIYDTSXLASGVPARFSGSGSGTDYTLTISSMEPEDFAVYYCQQXSSYPLTFGQGTKVEIK

SEQ ID NO: 1398 - protein, 98 aa, Artificial Sequence; identical to SEQ ID NO: 1368
  Description of Artificial Sequence: Synthetic polypeptide

SEQ ID NO: 1399 - protein, 15 aa, Artificial Sequence
  Description of Artificial Sequence: Synthetic peptide
YFDYWGQGTLVTVSS

SEQ ID NO: 1400 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (103)..(103): Asn, Gln, Ser or Ala
  MOD_RES (105)..(105): Trp, Tyr, Phe or His
QVQLQQSGAELMRPGTSVKVSCKASGYAFTXHLIEWIKQRPGQGLEWIGVIXPGSDSTDYNEKFKDKATLTADKSSSTAYMQLSSLTSDDSAVYFCARSLYYXSXFVYWGQGTLVTVSA

SEQ ID NO: 1401 - protein, 98 aa, Artificial Sequence
  Description of Artificial Sequence: Synthetic polypeptide
  MOD_RES (31)..(31): Gln, Ser or Ala
  MOD_RES (52)..(52): Asn, Gln, Ser or Ala
QVQLVQSGAEVKKPGASVKVSCKASGYTFTXYYMHWVRQAPGQGLEWMGIIXPSGGSTSYAQKFQGRVTMTRDTSTSTVYMELSSLRSEDTAVYYCAR

SEQ ID NO: 1402 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (103)..(103): Asn, Gln, Ser or Ala
  MOD_RES (105)..(105): Trp, Tyr, Phe or His
QVQLVQSGAEVKKPGASVKVSCKASGYAFTXHLIEWVRQAPGQGLEWMGVIXPGSDSTDYAQKFQGRVTMTRDTSTSTVYMELSSLRSEDTAVYYCARSLYYXSXFVYWGQGTLVTVSS

SEQ ID NO: 1403 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (103)..(103): Asn, Gln, Ser or Ala
  MOD_RES (105)..(105): Trp, Tyr, Phe or His
QVQLVQSGAEVKKPGASVKVSCKASGYAFTXHLIEWVRQAPGQGLEWIGVIXPGSDSTDYAQKFQGRVTMTADTSTSTVYMELSSLRSEDTAVYYCARSLYYXSXFVYWGQGTLVTVSS

SEQ ID NO: 1404 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (103)..(103): Asn, Gln, Ser or Ala
  MOD_RES (105)..(105): Trp, Tyr, Phe or His
QVQLVQSGAEVKKPGASVKVSCKASGYAFTXHLIEWIRQAPGQGLEWIGVIXPGSDSTDYAQKFQGRATLTADTSTSTAYMELSSLRSEDTAVYYCARSLYYXSXFVYWGQGTLVTVSS

SEQ ID NO: 1405 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (103)..(103): Asn, Gln, Ser or Ala
  MOD_RES (105)..(105): Trp, Tyr, Phe or His
QVQLVQSGAEVKKPGASVKVSCKASGYAFTXHLIEWIRQAPGQGLEWIGVIXPGSDSTDYAQKFQGRATLTADKSTSTAYMELSSLRSEDTAVYYCARSLYYXSXFVYWGQGTLVTVSS

SEQ ID NO: 1406 - protein, 96 aa, Artificial Sequence; identical to SEQ ID NO: 1376
  Description of Artificial Sequence: Synthetic polypeptide

SEQ ID NO: 1407 - protein, 12 aa, Artificial Sequence
  Description of Artificial Sequence: Synthetic peptide
YTFGQGTKLEIK

SEQ ID NO: 1408 - protein, 107 aa, Artificial Sequence
  Description of Artificial Sequence: Synthetic polypeptide
  MOD_RES (28)..(28): Asn, Gln, Ser, Ala or Asp
  MOD_RES (50)..(50): Asn, Gln, Ser, Ala or Asp
DIQMTQSPASLSASVGETVTITCRASEXIYSYLAWYQQKRGKSPQLLVYXAKTLVEGVPSRFSGSGSGTQFSLKINSLQPEDFGSYYCQHHYGTPYTFGGGTKLEIK

SEQ ID NO: 1409 - protein, 96 aa, Artificial Sequence
  Description of Artificial Sequence: Synthetic polypeptide
  MOD_RES (28)..(28): Gln, Ser, Ala or Asp
  MOD_RES (50)..(50): Gln, Ser, Ala or Asp
DIQMTQSPSSLSASVGDRVTITCRASQXISSYLNWYQQKPGKAPKLLIYXASSLQSGVPSRFSGSGSGTDFTLTISSLQPEDFATYYCQQSYSTPP

SEQ ID NO: 1410 - protein, 107 aa, Artificial Sequence
  Description of Artificial Sequence: Synthetic polypeptide
  MOD_RES (28)..(28): Asn, Gln, Ser, Ala or Asp
  MOD_RES (50)..(50): Asn, Gln, Ser, Ala or Asp
DIQMTQSPSSLSASVGDRVTITCRASEXIYSYLAWYQQKPGKAPKLLIYXAKTLVEGVPSRFSGSGSGTDFTLTISSLQPEDFATYYCQHHYGTPYTFGQGTKLEIK

SEQ ID NO: 1411 - protein, 107 aa, Artificial Sequence
  Description of Artificial Sequence: Synthetic polypeptide
  MOD_RES (28)..(28): Asn, Gln, Ser, Ala or Asp
  MOD_RES (50)..(50): Asn, Gln, Ser, Ala or Asp
DIQMTQSPSSLSASVGDRVTITCRASEXIYSYLAWYQQKPGKAPKLLVYXAKTLVEGVPSRFSGSGSGTDFTLTISSLQPEDFGTYYCQHHYGTPYTFGQGTKLEIK

SEQ ID NO: 1412 - protein, 98 aa, Artificial Sequence; identical to SEQ ID NO: 1368
  Description of Artificial Sequence: Synthetic polypeptide

SEQ ID NO: 1413 - protein, 15 aa, Artificial Sequence
  Description of Artificial Sequence: Synthetic peptide
YFDYWGQGTLVTVSS

SEQ ID NO: 1414 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLQQSGAELVRPGASVKVSCKTSGYAFTXYLIEWVKQRPGQGLEWIGVIXPGSGGIYYNDKFKVKTTLTADKSSSTAYMQLSSLTSDDSAVYFCARSETHDTXFAYWGQGTLVTVSA

SEQ ID NO: 1415 - protein, 98 aa, Artificial Sequence; identical to SEQ ID NO: 1401
  Description of Artificial Sequence: Synthetic polypeptide
  MOD_RES (31)..(31): Gln, Ser or Ala
  MOD_RES (52)..(52): Asn, Gln, Ser or Ala

SEQ ID NO: 1416 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKASGYAFTXYLIEWVRQAPGQGLEWMGVIXPGSGGIYYAQKFQGRVTMTRDTSTSTVYMELSSLRSEDTAVYYCARSETHDTXFAYWGQGTLVTVSS

SEQ ID NO: 1417 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKASGYAFTXYLIEWVRQAPGQGLEWIGVIXPGSGGIYYAQKFQGRVTMTADTSTSTVYMELSSLRSEDTAVYYCARSETHDTXFAYWGQGTLVTVSS

SEQ ID NO: 1418 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKTSGYAFTXYLIEWVRQAPGQGLEWIGVIXPGSGGIYYAQKFQGRVTLTADTSTSTAYMELSSLRSEDTAVYYCARSETHDTXFAYWGQGTLVTVSS

SEQ ID NO: 1419 - protein, 119 aa, Artificial Sequence
  Description of Artificial Sequence: Synthetic polypeptide
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKTSGYAFTXYLIEWVRQAPGQGLEWIGVIXPGSGGIYYAQKFQGRVTLTADKSTSTAYMELSSLRSEDTAVYYCARSETHDTXFAYWGQGTLVTVSS

SEQ ID NO: 1420 - protein, 96 aa, Artificial Sequence; identical to SEQ ID NO: 1376
  Description of Artificial Sequence: Synthetic polypeptide

SEQ ID NO: 1421 - protein, 12 aa, Artificial Sequence
  Description of Artificial Sequence: Synthetic peptide
YTFGQGTKLEIK

SEQ ID NO: 1422 - protein, 96 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISNLQPEDFATYYCLQHNSYPP

SEQ ID NO: 1423 - protein, 107 aa, Artificial Sequence
  Description of Artificial Sequence: Synthetic polypeptide
  MOD_RES (92)..(92): Trp, Tyr, Phe or His
  MOD_RES (93)..(93): Asn, Gln, Ser, Ala or Asp
DIVMTQSQKFISTSVGDRVSITCKASQSVRIAVAWFQQKPGQSPKALIYLASTRHTGVPDRFTGSGSGTDFTLTISNVQSEDLADYFCLQHXXYPYTFGGGTKLEIK

SEQ ID NO: 1424 - protein, 96 aa, Artificial Sequence
  Description of Artificial Sequence: Synthetic polypeptide
  MOD_RES (92)..(92): Tyr, Phe or His
  MOD_RES (93)..(93): Gln, Ser, Ala or Asp
DIQMTQSPSSLSASVGDRVTITCRASQSISSYLNWYQQKPGKAPKLLIYAASSLQSGVPSRFSGSGSGTDFTLTISSLQPEDFATYYCQQSXXTPP

SEQ ID NO: 1425 - protein, 107 aa, Artificial Sequence
  Description of Artificial Sequence: Synthetic polypeptide
  MOD_RES (92)..(92): Trp, Tyr, Phe or His
  MOD_RES (93)..(93): Asn, Gln, Ser, Ala or Asp
DIQMTQSPSSLSASVGDRVTITCKASQSVRIAVAWYQQKPGKAPKLLIYLASTRHTGVPSRFSGSGSGTDFTLTISSLQPEDFATYYCLQHXXYPYTFGQGTKLEIK

SEQ ID NO: 1426 - protein, 107 aa, Artificial Sequence
  Description of Artificial Sequence: Synthetic polypeptide
  MOD_RES (92)..(92): Trp, Tyr, Phe or His
  MOD_RES (93)..(93): Asn, Gln, Ser, Ala or Asp
DIQMTQSPSSLSASVGDRVTITCKASQSVRIAVAWFQQKPGKAPKALIYLASTRHTGVPSRFSGSGSGTDFTLTISSVQPEDFATYYCLQHXXYPYTFGQGTKLEIK

SEQ ID NO: 1427 - protein, 98 aa, Artificial Sequence; identical to SEQ ID NO: 1368
  Description of Artificial Sequence: Synthetic polypeptide

SEQ ID NO: 1428 - protein, 15 aa, Artificial Sequence
  Description of Artificial Sequence: Synthetic peptide
YFDYWGQGTLVTVSS

SEQ ID NO: 1429 - protein, 120 aa, Artificial Sequence
  Description of Artificial Sequence: Synthetic polypeptide
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLQQSGAELVRPGTSVKMSCKAAGYTFTXYXIGWVKQRPGHGLEWIGDIYPGGGYTXYNEKFKGKATLTADTSSSTAYMQLSSLTSEDSAIYYCASPYYGSSYGFAFWGQGTLVTVSA

SEQ ID NO: 1430 - protein, 98 aa, Artificial Sequence
  Description of Artificial Sequence: Synthetic polypeptide
  MOD_RES (31)..(31): Gln, Ser or Ala
  MOD_RES (33)..(33): Tyr, Phe or His
  MOD_RES (59)..(59): Gln, Ser or Ala
QVQLVQSGAEVKKPGASVKVSCKASGYTFTXYXMHWVRQAPGQGLEWMGIINPSGGSTXYAQKFQGRVTMTRDTSTSTVYMELSSLRSEDTAVYYCAR

SEQ ID NO: 1431 - protein, 120 aa, Artificial Sequence
  Description of Artificial Sequence: Synthetic polypeptide
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLVQSGAEVKKPGASVKVSCKASGYTFTXYXIGWVRQAPGQGLEWMGDIYPGGGYTXYAQKFQGRVTMTRDTSTSTVYMELSSLRSEDTAVYYCARPYYGSSYGFAFWGQGTLVTVSS

SEQ ID NO: 1432 - protein, 120 aa, Artificial Sequence
  Description of Artificial Sequence: Synthetic polypeptide
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLVQSGAEVKKPGASVKVSCKASGYTFTXYXIGWVRQAPGQGLEWIGDIYPGGGYTXYAQKFQGRVTMTADTSTSTVYMELSSLRSEDTAVYYCASPYYGSSYGFAFWGQGTLVTVSS

SEQ ID NO: 1433 - protein, 120 aa, Artificial Sequence
  Description of Artificial Sequence: Synthetic polypeptide
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLVQSGAEVKKPGASVKMSCKASGYTFTXYXIGWVRQAPGQGLEWIGDIYPGGGYTXYAQKFQGRATLTADTSTSTAYMELSSLRSEDTAVYYCASPYYGSSYGFAFWGQGTLVTVSS

SEQ ID NO: 1434 - protein, 120 aa, Artificial Sequence
  Description of Artificial Sequence: Synthetic polypeptide
QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSS

SEQ ID NO: 1435 - protein, 120 aa, Artificial Sequence
  Description of Artificial Sequence: Synthetic polypeptide
QVQLVQSGAEVKKPGASVKVSCKASGYTFTDYNINWVRQAPGQGLEWIGYIYPYIGGSGYAQKFQGRVTMTADTSTSTVYMELSSLRSEDTAVYYCAREDKTARNAMDYWGQGTLVTVSS

SEQ ID NO: 1436 - protein, 120 aa, Artificial Sequence
  Description of Artificial Sequence: Synthetic polypeptide
QVQLVQSGAEVKKPGASVKISCKASGYTFTDYNINWVRQAPGQGLEWIGYIYPYIGGSGYAQKFQGRATLTADTSTSTAYMELSSLRSEDTAVYYCAREDKTARNAMDYWGQGTLVTVSS

SEQ ID NO: 1437 - protein, 120 aa, Artificial Sequence
  Description of Artificial Sequence: Synthetic polypeptide
QVQLVQSGAEVKKPGASVKISCKASGYTFTDYNINWVRQAPGQGLEWIGYIYPYIGGSGYAQKFQGRATLTADNSTSTAYMELSSLRSEDTAVYYCAREDKTARNAMDYWGQGTLVTVSS

SEQ ID NO: 1438 - protein, 118 aa, Artificial Sequence
  Description of Artificial Sequence: Synthetic polypeptide
QVQLVQSGAEVKKPGASVKVSCKASGYKFPDYVMHWVRQAPGQGLEWMGIISIYSGNTNYAQKFQGRVTMTRDTSTSTVYMELSSLRSEDTAVYYCAREGDLPMFAYWGQGTLVTVSS

SEQ ID NO: 1439 - protein, 118 aa, Artificial Sequence
  Description of Artificial Sequence: Synthetic polypeptide
QVQLVQSGAEVKKPGASVKVSCKASGYKFPDYVMHWVRQAPGQGLEWIGIISIYSGNTNYAQKFQGRVTMTVDTSTSTVYMELSSLRSEDTAVYYCAREGDLPMFAYWGQGTLVTVSS

SEQ ID NO: 1440 - protein, 118 aa, Artificial Sequence
  Description of Artificial Sequence: Synthetic polypeptide
QVQLVQSGAEVKKPGASVKISCKGSGYKFPDYVMHWVRQAPGQGLEWIGIISIYSGNTNYAQKFQGRATMTVDTSTSTAYMELSSLRSEDTAVYYCAREGDLPMFAYWGQGTLVTVSS

SEQ ID NO: 1441 - protein, 118 aa, Artificial Sequence
  Description of Artificial Sequence: Synthetic polypeptide
QVQLVQSGAEVKKPGASVKISCKGSGYKFPDYVMHWVRQAPGQGLEWIGIISIYSGNTNYAQKFQGRATMTVDKSTSTAYMELSSLRSEDTAVYYCAREGDLPMFAYWGQGTLVTVSS

SEQ ID NO: 1442 - protein, 119 aa, Artificial Sequence
  Description of Artificial Sequence: Synthetic polypeptide
QVQLVQSGAEVKKPGASVKVSCKASGYAFTNHLIEWVRQAPGQGLEWMGVINPGSDSTDYAQKFQGRVTMTRDTSTSTVYMELSSLRSEDTAVYYCARSLYYNSWFVYWGQGTLVTVSS

SEQ ID NO: 1443 - protein, 119 aa, Artificial Sequence
  Description of Artificial Sequence: Synthetic polypeptide
QVQLVQSGAEVKKPGASVKVSCKASGYAFTNHLIEWVRQAPGQGLEWIGVINPGSDSTDYAQKFQGRVTMTADTSTSTVYMELSSLRSEDTAVYYCARSLYYNSWFVYWGQGTLVTVSS

SEQ ID NO: 1444 - protein, 119 aa, Artificial Sequence
  Description of Artificial Sequence: Synthetic polypeptide
QVQLVQSGAEVKKPGASVKVSCKASGYAFTNHLIEWIRQAPGQGLEWIGVINPGSDSTDYAQKFQGRATLTADTSTSTAYMELSSLRSEDTAVYYCARSLYYNSWFVYWGQGTLVTVSS

SEQ ID NO: 1445 - protein, 119 aa, Artificial Sequence
  Description of Artificial Sequence: Synthetic polypeptide
QVQLVQSGAEVKKPGASVKVSCKASGYAFTNHLIEWIRQAPGQGLEWIGVINPGSDSTDYAQKFQGRATLTADKSTSTAYMELSSLRSEDTAVYYCARSLYYNSWFVYWGQGTLVTVSS

SEQ ID NO: 1446 - protein, 119 aa, Artificial Sequence
  Description of Artificial Sequence: Synthetic polypeptide
QVQLVQSGAEVKKPGASVKVSCKASGYAFTNYLIEWVRQAPGQGLEWMGVINPGSGGIYYAQKFQGRVTMTRDTSTSTVYMELSSLRSEDTAVYYCARSETHDTWFAYWGQGTLVTVSS

SEQ ID NO: 1447 - protein, 119 aa, Artificial Sequence
  Description of Artificial Sequence: Synthetic polypeptide
QVQLVQSGAEVKKPGASVKVSCKASGYAFTNYLIEWVRQAPGQGLEWIGVINPGSGGIYYAQKFQGRVTMTADTSTSTVYMELSSLRSEDTAVYYCARSETHDTWFAYWGQGTLVTVSS

SEQ ID NO: 1448 - protein, 119 aa, Artificial Sequence
  Description of Artificial Sequence: Synthetic polypeptide
QVQLVQSGAEVKKPGASVKVSCKTSGYAFTNYLIEWVRQAPGQGLEWIGVINPGSGGIYYAQKFQGRVTLTADTSTSTAYMELSSLRSEDTAVYYCARSETHDTWFAYWGQGTLVTVSS

SEQ ID NO: 1449 - protein, 119 aa, Artificial Sequence
  Description of Artificial Sequence: Synthetic polypeptide
QVQLVQSGAEVKKPGASVKVSCKTSGYAFTNYLIEWVRQAPGQGLEWIGVINPGSGGIYYAQKFQGRVTLTADKSTSTAYMELSSLRSEDTAVYYCARSETHDTWFAYWGQGTLVTVSS

SEQ ID NO: 1450 - protein, 120 aa, Artificial Sequence
  Description of Artificial Sequence: Synthetic polypeptide
QVQLVQSGAEVKKPGASVKVSCKASGYTFTNYWIGWVRQAPGQGLEWMGDIYPGGGYTNYAQKFQGRVTMTRDTSTSTVYMELSSLRSEDTAVYYCARPYYGSSYGFAFWGQGTLVTVSS

SEQ ID NO: 1451 - protein, 120 aa, Artificial Sequence
  Description of Artificial Sequence: Synthetic polypeptide
QVQLVQSGAEVKKPGASVKVSCKASGYTFTNYWIGWVRQAPGQGLEWIGDIYPGGGYTNYAQKFQGRVTMTADTSTSTVYMELSSLRSEDTAVYYCASPYYGSSYGFAFWGQGTLVTVSS

SEQ ID NO: 1452 - protein, 120 aa, Artificial Sequence
  Description of Artificial Sequence: Synthetic polypeptide
QVQLVQSGAEVKKPGASVKMSCKASGYTFTNYWIGWVRQAPGQGLEWIGDIYPGGGYTNYAQKFQGRATLTADTSTSTAYMELSSLRSEDTAVYYCASPYYGSSYGFAFWGQGTLVTVSS

SEQ ID NO: 1453 - protein, 107 aa, Artificial Sequence
  Description of Artificial Sequence: Synthetic polypeptide
DIQMTQSPSSLSASVGDRVTITCRVSENIYSNLAWYQQKPGKAPKLLIYEATNLAEGVPSRFSGSGSGTDFTLTISSLQPEDFATYYCQHFWGTPYTFGQGTKLEIK

SEQ ID NO: 1454 - protein, 107 aa, Artificial Sequence
  Description of Artificial Sequence: Synthetic polypeptide
DIQMTQSPSSLSASVGDRVTITCRVSENIYSNLAWYQQKPGKAPKLLIYEATNLAEGVPSRFSGSGSGTDYTLTISSLQPEDFATYYCQHFWGTPYTFGQGTKLEIK

SEQ ID NO: 1455 - protein, 107 aa, Artificial Sequence
  Description of Artificial Sequence: Synthetic polypeptide
DIQMTQSPSSLSASVGDRVTITCRVSENIYSNLAWYQQKPGKAPKLLVYEATNLAEGVPSRFSGSGSGTDYTLTISSLQPEDFGTYYCQHFWGTPYTFGQGTKLEIK

SEQ ID NO: 1456 - protein, 106 aa, Artificial Sequence
  Description of Artificial Sequence: Synthetic polypeptide
EIVLTQSPATLSLSPGERATLSCNASSSVSYMYWYQQKPGQAPRLLIYDTSNLASGIPARFSGSGSGTDFTLTISSLEPEDFAVYYCQQWSSYPLTFGQGTKLEIK

SEQ ID NO: 1457 - protein, 106 aa, Artificial Sequence
  Description of Artificial Sequence: Synthetic polypeptide
EIVLTQSPATLSLSPGERATLSCNASSSVSYMYWYQQKPGQAPRLLIYDTSNLASGIPARFSGSGSGTDYTLTISSLEPEDFAVYYCQQWSSYPLTFGQGTKLEIK

SEQ ID NO: 1458 - protein, 106 aa, Artificial Sequence
  Description of Artificial Sequence: Synthetic polypeptide
EIVLTQSPATLSLSPGERVTMSCNASSSVSYMYWYQQKPGQAPRLLIYDTSNLASGVPARFSGSGSGTDYTLTISSMEPEDFAVYYCQQWSSYPLTFGQGTKVEIK

SEQ ID NO: 1459 - protein, 107 aa, Artificial Sequence
  Description of Artificial Sequence: Synthetic polypeptide
DIQMTQSPSSLSASVGDRVTITCRASENIYSYLAWYQQKPGKAPKLLIYNAKTLVEGVPSRFSGSGSGTDFTLTISSLQPEDFATYYCQHHYGTPYTFGQGTKLEIK

SEQ ID NO: 1460 - protein, 107 aa, Artificial Sequence
  Description of Artificial Sequence: Synthetic polypeptide
DIQMTQSPSSLSASVGDRVTITCRASENIYSYLAWYQQKPGKAPKLLVYNAKTLVEGVPSRFSGSGSGTDFTLTISSLQPEDFGTYYCQHHYGTPYTFGQGTKLEIK

SEQ ID NO: 1461 - protein, 107 aa, Artificial Sequence
  Description of Artificial Sequence: Synthetic polypeptide
DIQMTQSPSSLSASVGDRVTITCKASQSVRIAVAWYQQKPGKAPKLLIYLASTRHTGVPSRFSGSGSGTDFTLTISSLQPEDFATYYCLQHWNYPYTFGQGTKLEIK

SEQ ID NO: 1462 - protein, 107 aa, Artificial Sequence
  Description of Artificial Sequence: Synthetic polypeptide
DIQMTQSPSSLSASVGDRVTITCKASQSVRIAVAWFQQKPGKAPKALIYLASTRHTGVPSRFSGSGSGTDFTLTISSVQPEDFATYYCLQHWNYPYTFGQGTKLEIK

SEQ ID NO: 1463 - protein, 131 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRAD

SEQ ID NO: 1464 - protein, 131 aa, Macaca fascicularis
TPEVWVQVQMEATELSSFTVHCGFLGPGSISLVTVSWGGPDGAGGTKLAVLHPELGTRQWAPARQARWETQSSISLALEDSGASSPFANTTFCCKFASFPEGSWESCGSLPPSSDPGLSAPPTPVPILRAD

SEQ ID NO: 1465 - protein, 126 aa, Callithrix jacchus
TPEVWVQVQMKATELSSFIVHCGFLGSGSISLVTVSWGGPDGAGGTRLAVLHPELGTRQWAPAHQARWETQSSISLVLEEPGASSPSANTTFCCKFASFPEGSWEACGSLPPSSDPGLSAPILRAD

SEQ ID NO: 1466 - protein, 131 aa, Macaca mulatta; identical to SEQ ID NO: 1464

SEQ ID NO: 1467 - protein, 131 aa, Homo sapiens; identical to SEQ ID NO: 1463

SEQ ID NO: 1468 - protein, 151 aa, Homo sapiens
MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRAD

SEQ ID NO: 1469 - protein, 104 aa, Homo sapiens
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

SEQ ID NO: 1470 - protein, 179 aa, Artificial Sequence
  Description of Artificial Sequence: Synthetic polypeptide
MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHR

SEQ ID NO: 1471 - protein, 191 aa, Artificial Sequence
  Description of Artificial Sequence: Synthetic polypeptide
MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSVPPTPAPILRADLAGILGVSGVLLFDCGYLLHLLCRQKHRPAPRLQPSHTSS

SEQ ID NO: 1472 - protein, 211 aa, Artificial Sequence
  Description of Artificial Sequence: Synthetic polypeptide
MGHRTLVLPWVLLTLCVTAGTPEVWVQVRMEATELSSFTIRWLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 1473 - protein, 189 aa, Artificial Sequence
  Description of Artificial Sequence: Synthetic polypeptide
MGHRTLVLPWVLLTLCVTAGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 1474 - protein, 74 aa, Artificial Sequence
  Description of Artificial Sequence: Synthetic polypeptide
MGHRTLVLPWVLLTLCVTAGLSVPPTPAPILRADLAGILGVSGVLLFDCGYLLHLLCRQKHRPAPRLQPSHTSS

SEQ ID NO: 1475 - protein, 203 aa, Artificial Sequence [sequence omitted]

SEQ ID NO: 1476 - protein, 230 aa, Artificial Sequence
  Description of Artificial Sequence: Synthetic polypeptide
MGHRTLVLPWVLLTLCVTAGTPEVWVQVRMEATELSSFTIRCGFLGSGSISLVTVSWGGPNGAGGTTLAVLHPERGAQISPRGPKIGGPPCPRPGPAGKPRAASLSSWKALGPAAPAPTPPSAASLRPSQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 1477 - protein, 182 aa, Artificial Sequence
  Description of Artificial Sequence: Synthetic polypeptide
MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPGCSSRPLCHYQHQLPPSYFGHSSPPWGAVLVGVTPHPRCTPAPGPCRLGLHTHPCTWQLCLC

SEQ ID NO: 1478 - protein, 183 aa, Artificial Sequence
  Description of Artificial Sequence: Synthetic polypeptide
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGGAGARGPGGQGGARELATHLILVSVPRALCPADSCPHSAGRPGRDLGGLRSPPLWLCLPPSSAAPT

SEQ ID NO: 1479 - protein, 210 aa, Artificial Sequence
  Description of Artificial Sequence: Synthetic polypeptide
TPEVWVQVRMEATELSSFTIRCGFLGSGSISLVTVSWGGPNGAGGTTLAVLHPERGAQISPRGPKIGGPPCPRPGPAGKPRAASLSSWKALGPAAPAPTPPSAASLRPSQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 1480 - protein, 162 aa, Artificial Sequence
  Description of Artificial Sequence: Synthetic polypeptide
TPEVWVQVRMEATELSSFTIRCGFLGSGSISLVTVSWGGPNGAGGTTLAVLHPERGIRQWAPARQARWETQSSISLILEGSGASSPCANTTFCCKFASFPGCSSRPLCHYQHQLPPSYFGHSSPPWGAVLVGVTPHPRCTPAPGPCRLGLHTHPCTWQLCLC

SEQ ID NO: 1481 - protein, 66 aa, Artificial Sequence
  Description of Artificial Sequence: Synthetic polypeptide
GAGARGPGGQGGARELATHLILVSVPRALCPADSCPHSAGRPGRDLGGLRSPPLWLCLPPSSAAPT

SEQ ID NO: 1482 - protein, 154 aa, Artificial Sequence
  Description of Artificial Sequence: Synthetic polypeptide
AQISPRGPKIGGPPCPRPGPAGKPRAASLSSWKALGPAAPAPTPPSAASLRPSQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 1483 - protein, 52 aa, Artificial Sequence
  Description of Artificial Sequence: Synthetic polypeptide
AQISPRGPKIGGPPCPRPGPAGKPRAASLSSWKALGPAAPAPTPPSAASLRP

SEQ ID NO: 1484 - protein, 62 aa, Artificial Sequence
  Description of Artificial Sequence: Synthetic polypeptide
GCSSRPLCHYQHQLPPSYFGHSSPPWGAVLVGVTPHPRCTPAPGPCRLGLHTHPCTWQLCLC

SEQ ID NO: 1485 - protein, 129 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILR

SEQ ID NO: 1486 - protein, 130 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRA

SEQ ID NO: 1487 - protein, 132 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADL

SEQ ID NO: 1488 - protein, 133 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLA

SEQ ID NO: 1489 - protein, 104 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSW

SEQ ID NO: 1490 - protein, 105 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

SEQ ID NO: 1491 - protein, 106 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

SEQ ID NO: 1492 - protein, 107 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

SEQ ID NO: 1493 - protein, 108 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

SEQ ID NO: 1494 - protein, 103 aa, Homo sapiens
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSW

SEQ ID NO: 1495 - protein, 104 aa, Homo sapiens
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

SEQ ID NO: 1496 - protein, 105 aa, Homo sapiens
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

SEQ ID NO: 1497 - protein, 106 aa, Homo sapiens
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

SEQ ID NO: 1498 - protein, 107 aa, Homo sapiens
PEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

SEQ ID NO: 1499 - protein, 102 aa, Homo sapiens
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSW

SEQ ID NO: 1500 - protein, 103 aa, Homo sapiens
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

SEQ ID NO: 1501 - protein, 105 aa, Homo sapiens
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

SEQ ID NO: 1502 - protein, 106 aa, Homo sapiens
EVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

SEQ ID NO: 1503 - protein, 101 aa, Homo sapiens
VWVQVRMEATELSSFTIRCGFLGSGSISLVTVSWGGPNGAGGTTLAVLHPERGIRQWAPARQARWETQSSISLILEGSGASSPCANTTFCCKFASFPEGSW

SEQ ID NO: 1504 - protein, 102 aa, Homo sapiens
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWE

SEQ ID NO: 1505 - protein, 103 aa, Homo sapiens
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

SEQ ID NO: 1506 - protein, 104 aa, Homo sapiens
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

SEQ ID NO: 1507 - protein, 105 aa, Homo sapiens
VWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

SEQ ID NO: 1508 - protein, 100 aa, Homo sapiens
WVQVRMEATELSSFTIRCGFLGSGSISLVTVSWGGPNGAGGTTLAVLHPERGIRQWAPARQARWETQSSISLILEGSGASSPCANTTFCCKFASFPEGSW

SEQ ID NO: 1509 - protein, 101 aa, Homo sapiens
WVQVRMEATELSSFTIRCGFLGSGSISLVTVSWGGPNGAGGTTLAVLHPERGIRQWAPARQARWETQSSISLILEGSGASSPCANTTFCCKFASFPEGSWE

SEQ ID NO: 1510 - protein, 102 aa, Homo sapiens
WVQVRMEATELSSFTIRCGFLGSGSISLVTVSWGGPNGAGGTTLAVLHPERGIRQWAPARQARWETQSSISLILEGSGASSPCANTTFCCKFASFPEGSWEA

SEQ ID NO: 1511 - protein, 103 aa, Homo sapiens
WVQVRMEATELSSFTIRCGFLGSGSISLVTVSWGGPNGAGGTTLAVLHPERGIRQWAPARQARWETQSSISLILEGSGASSPCANTTFCCKFASFPEGSWEAC

SEQ ID NO: 1512 - protein, 104 aa, Homo sapiens
WVQVRMEATELSSFTIRCGFLGSGSISLVTVSWGGPNGAGGTTLAVLHPERGIRQWAPARQARWETQSSISLILEGSGASSPCANTTFCCKFASFPEGSWEACG

SEQ ID NO: 1513 - protein, 234 aa, Mus musculus
MRTGNTQAAHATNMGQMQTLVLFSTLLTLCVSEASPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISMENGLYALA

SEQ ID NO: 1514 - protein, 221 aa, Mus musculus
MGQMQTLVLFSTLLTLCVSEASPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISMENGLYALA

SEQ ID NO: 1515 - protein, 131 aa, Mus musculus
SPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQAD

SEQ ID NO: 1516 - protein, 152 aa, Mus musculus
MGQMQTLVLFSTLLTLCVSEASPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQAD

SEQ ID NO: 1517 - protein, 363 aa, Artificial Sequence
  Description of Artificial Sequence: Synthetic polypeptide
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1518 - protein, 363 aa, Artificial Sequence
  Description of Artificial Sequence: Synthetic polypeptide
TPEVWVQVRMEATELSSFTIRCGFLGSGSISLVTVSWGGPNGAGGTTLAVLHPERGIRQWAPARQARWETQSSISLILEGSGASSPFANTTFCCKFASFPEGSWEASGSLPPSSDPGLSAPPTPAPILRADEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1519 - protein, 363 aa, Artificial Sequence
  Description of Artificial Sequence: Synthetic polypeptide
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1520 - protein, 363 aa, Artificial Sequence
  Description of Artificial Sequence: Synthetic polypeptide
TPEVWVQVRMEATELSSFTIRCGFLGSGSISLVTVSWGGPNGAGGTTLAVLHPERGIRQWAPARQARWETQSSISLILEGSGASSPFANTTFCCKFASFPEGSWEACGSLPPSSDPGLSAPPTPAPILRADEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1521 - protein, 364 aa, Artificial Sequence
  Description of Artificial Sequence: Synthetic polypeptide
SPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQADEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1522 - protein, 364 aa, Artificial Sequence
  Description of Artificial Sequence: Synthetic polypeptide
SPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQADEPRGPTIKPSPPSKSPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1523 - protein, 232 aa, Homo sapiens
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1524 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1525 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1526 - protein, 217 aa, Artificial Sequence
  Description of Artificial Sequence: Synthetic polypeptide
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1527 - protein, 233 aa, Mus musculus
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1528 - protein, 233 aa, Artificial Sequence
  Description of Artificial Sequence: Synthetic polypeptide
EPRGPTIKPCPPCKCPAPNLLGGPSVFIFPPKIKDVLMISLSPIVTCVVVDVSEDDPDVQISWFVNNVEVHTAQTQTHREDYASTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1529 - protein, 217 aa, Artificial Sequence
  Description of Artificial Sequence: Synthetic polypeptide
APNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1530 - protein, 232 aa, Artificial Sequence
  Description of Artificial Sequence: Synthetic polypeptide
EPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1531 - DNA, 20 bp, Artificial Sequence
  Description of Artificial Sequence: Synthetic primer
ccaccaacctctcgtctttc

SEQ ID NO: 1532 - DNA, 18 bp, Artificial Sequence
  Description of Artificial Sequence: Synthetic primer
tcatgccagagcatacag

SEQ ID NO: 1533 - DNA, 20 bp, Artificial Sequence
  Description of Artificial Sequence: Synthetic primer
cagtgcctctaactgctgac

SEQ ID NO: 1534 - DNA, 22 bp, Artificial Sequence
  Description of Artificial Sequence: Synthetic primer
tcactgttaccagggagatgag

SEQ ID NO: 1535 - DNA, 19 bp, Artificial Sequence
  Description of Artificial Sequence: Synthetic primer
cacaggctgcccatgcaac

SEQ ID NO: 1536 - DNA, 20 bp, Artificial Sequence
  Description of Artificial Sequence: Synthetic primer
tgcctgggtgctagtgagag

SEQ ID NO: 1537 - DNA, 20 bp, Artificial Sequence
  Description of Artificial Sequence: Synthetic primer
ccaccaacctctcgtctttc

SEQ ID NO: 1538 - DNA, 20 bp, Artificial Sequence
  Description of Artificial Sequence: Synthetic primer
gaccctgttacctgtcattg

SEQ ID NO: 1539 - protein, 314 aa, Artificial Sequence
  Description of Artificial Sequence: Synthetic polypeptide
MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVRDYKDDDDK

SEQ ID NO: 1540 - protein, 242 aa, Artificial Sequence
  Description of Artificial Sequence: Synthetic polypeptide
MRTGNTQAAHATNMGQMQTLVLFSTLLTLCVSEADYKDDDDKSPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISMENGLYALA

SEQ ID NO: 1541 - protein, 218 aa, Artificial Sequence
  Description of Artificial Sequence: Synthetic polypeptide
MQTLVLFSTLLTLCVSEASPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISMENGLYALA

SEQ ID NO: 1542 - protein, 226 aa, Artificial Sequence
  Description of Artificial Sequence: Synthetic polypeptide
MQTLVLFSTLLTLCVSEADYKDDDDKSPEVWVQVQMEATNLSSFSVHCGVLGYSLISLVTVSCEGFVDAGRTKLAVLHPEFGTQQWAPARQAHWETPNSVSVTLTMGQSKARSSLANTTFCCEFVTFPHGSRVACRDLHRSDPGLSAPTPALNLQADLVRILGTSGVFLFGFIFILCLRWQQRHWCLSKSQPSLTSTQAQVETQPPHLASTHSSFISMENGLYALA

The invention claimed is:

1. A method of activating T-cells of a patient with cancer comprising administering an anti-PVRIG antibody to said patient, wherein said antibody comprises:
   i) the vhCDR1, vhCDR2, and vhCDR3 from SEQ ID NO:1434 and
   ii) the vlCDR1, vlCDR2, and vlCDR3 from SEQ ID NO:1453,
wherein a subset of said T-cells of said patient are activated.

2. A method according to claim 1 wherein said antibody comprises the heavy chain variable domain of SEQ ID NO:1434 and the light chain variable domain of SEQ ID NO:1453.

3. A method according to claim 2 wherein said antibody further comprises the CH1-hinge-CH2-CH3 region from IgG1, IgG2, IgG3, or IgG4, wherein said hinge region optionally comprises mutations.

4. A method according to claim 2 wherein said antibody further comprises the CL region of human kappa 2 light chain.

5. A method according to claim 1 wherein said T-cells are cytotoxic T-cells (CTLs).

6. A method according to claim 1 wherein said T-cells are selected from the group consisting of $CD4^+$ T-cells and $CD8^+$ T-cells.

7. A method according to claim 1 wherein said activation is measured as an increase in interferon-γ production and/or an increase in cytokine secretion.

8. A method of activating T-cells of a patient with cancer comprising administering an anti-PVRIG antibody to said patient, wherein said antibody comprises:
   i) the vhCDR1, vhCDR2, and vhCDR3 from SEQ ID NO:1447 and
   ii) the vlCDR1, vlCDR2, and vlCDR3 from SEQ ID NO:1462,
wherein a subset of said T-cells of said patient are activated.

9. A method according to claim 8 wherein said antibody comprises the heavy chain variable domain of SEQ ID NO:1447 and the light chain variable domain of SEQ ID NO:1462.

10. A method according to claim 9 wherein said antibody further comprises the CH1-hinge-CH2-CH3 region from IgG1, IgG2, IgG3, or IgG4, wherein said hinge region optionally comprises mutations.

11. A method according to claim 9 wherein said antibody further comprises the CL region of human kappa 2 light chain.

12. A method according to claim 8 wherein said T-cells are cytotoxic T-cells (CTLs).

13. A method according to claim 8 wherein said T-cells are selected from the group consisting of CD4$^+$ T-cells and CD8$^+$ T-cells.

14. A method according to claim 8 wherein said activation is measured as an increase in interferon-γ production and/or an increase in cytokine secretion.

15. A method of activating T-cells of a patient with cancer comprising administering an anti-PVRIG antibody to said patient, wherein said antibody comprises:
   a) a heavy chain variable domain comprising:
      i) a vhCDR1 comprising SEQ ID NO:885;
      ii) a vhCDR2 comprising SEQ ID NO:886;
      iii) a vhCDR3 comprising SEQ ID NO:887; and
   b) a light chain variable domain comprising:
      i) a vlCDR1 comprising SEQ ID NO:889;
      ii) a vlCDR2 comprising SEQ ID NO:890;
      iii) a vlCDR3 comprising SEQ ID NO:891,
wherein a subset of said T-cells of said patient are activated.

16. A method according to claim 15 wherein said antibody further comprises the CH1-hinge-CH2-CH3 region from IgG1, IgG2, IgG3, or IgG4, wherein said hinge region optionally comprises mutations.

17. A method according to claim 15 wherein said antibody further comprises the CL region of human kappa 2 light chain.

18. A method according to claim 15 wherein said T-cells are cytotoxic T-cells (CTLs).

19. A method according to claim 15 wherein said T-cells are selected from the group consisting of CD4$^+$ T-cells and CD8$^+$ T-cells.

20. A method according to claim 15 wherein said activation is measured as an increase in interferon-γ production and/or an increase in cytokine secretion.

* * * * *